United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 7

SEQ ID NO: 26 - DNA, 3120524 bp, Anaerostipes hadrus (residues 1,560,263-3,120,524 of 3,120,524)
ctcacggattttatgaacactatggatttgaaaaaagctgttatggatttgaattagctttgtagaagaaaggaaaattaatgaaaatattagtcagtgcctgcctgttaggaatcgattgcaaatataacggaaaaaacaacaaaaatgataaaatcatagaattactaaaagaccatgaactaattccagtctgtccagagatcatgggaggactgccaacaccaagaattccggcagaaatacatcaaaacaaagttatcgcaaaagatggcaaagatgttacaaaacaataccaaaaaggtgccgaagagacactaaaaattgcaaagttatataactgtcatacagcgatcctaaaagaaaaaagtccatcttgtggctgtggcaaagtctatgatggaacatttacaggcacgctgatcaatggggacggaatcacagctagattattaaaagaacatggaatcaaaatcacaggggaaacaaccttagatatcacagaataaaacagtgaacagtaaaatgaggatccaaatatgaacaacaaacaaaaactattaaccgcaacagcgatcacaggaactattgtcagtgcatctgcatttactgtcttcgattatgcgatctgtcgaagaaaaaaacagccagatgtccgtaaaaaagaaaaatggaaaccatatcttgattacgttttaaaagaacaagaatggctaaaagaacaccaagaacaagaattaaaggaaatcagatcaaaagacggactaacactacgggcagcctacatcccaagagaaaatgccaaaggaactattatctgtatgcacggttaccattcaacaaacgatatcgaattcgtaccggaagtccgatttctatggaatcttggatacagcattcttcttccatggcagagaagccacggaaaaagcgaaggacgctatattacttatggagtgaaagaacgccatgatctcaaacgatggattttgtataccaatcggcatctggcagccaagaacaaagatatttttctatgtggaatttctatggggtgtgctacaaccttaatggcagcaggtctggaccttccagacaatgtaaaaggaattattgctgactgcggattcacttctccatgggatatcatcaaacacgtagccaaagaaagattttatcttccaccatttccattaatgtacatggtagatttgatcagtgaagtagtagcaggatttggattgaaagaagtcagcatcccagaaatcatgaaacgaaacaagattccagtgttgtttatccatggagatgcagacgattacgttccgatgtggatgacaatcaaaaattatgaagcctgtgcagcaaagaaagaactctatattgtttcaggagcaggacacgcactagcattttcaaaagatatggaagagggaaaacgaagaatcaaaaatttcataaataaatataagacgatctaaaataagaagaaccattccgtataaatgatgttacagaatggttcttgtattataaatttcctaaaaaacctattttaagatcataagataactttccggccgctgtgtgatcttgatttctttcagaattctaaaattagattttacagcgaactgttttacatattcacggtttcttgtatacataatgattgttccttcaggtccaagaactcttttggcaaatggaaagaacttctcataaacctcacgaatctccgcttctgtcttctggccagtcgcataaggcatctccgtaaagatttcatcaaaaggatagtcatgggtaaatgtaaaacaatccttattgatataatgaacgatctggtctgcaagatttgtgttatagatcgctttctcaatggcttctggagaatgatcgataccataagaagtattcccttttacaaccttctgacgctcgatcagcatcgtaccaaccccacagaaaggatcaagaatctgcgcatccgggatcatgtaatctttggcaagttccacaagtaaagcagcattgactggtttgatacttgttggaatgaactcctcgcggtaactaaaacgacgatcaacgattgtatttaattttactaataaataataatccccagatttaccttcgatcatacggatctcaaattcataatgagaggtagaatttcttaatttatgtgctgtcagctcttctaatttcgaagcaactttcttcgcaaatttggaacgttcagaaagtgacatacggcttttcactccgattcggaaataaaaaggaaaatccccttcatgagtattttctaataatgccattaaattcgaaccagcgatcacggatgcagcaacatcagcatcaggtttacatgaaaccatgcctggaatctgaaataacaattcattgtatgtgcggatcggtaataaacgattcagatgatttgtctttacacgcacgcccatttttgaagaagcagctgaagattcttccatcaaggcagcagtaatttccgggtgtaatgggttagtgcggaaaatacaatgaaatgtctggcgaccgcctaaaaatctatgcttcttaaatggttcaatagtattgatcagttcagaaagtgcatgaagttcatgttctacatgctttttctcatcgtcagaagcttcataaagagataattcttcataacgttttcggaaaacatccacataaggagccgcatttaaagattttaaagcagttaaataagcctcttttacaaaacgtgtatcttctgtctgataagcatgaaatacagcatcgctttcagaagaaagtgccagatcaccgatcaaaagagcagcattttttcttgtttttgcatcttcattttctaaaaatacggataagtccagatcaccatcatggatccaagacaacaaaagttctcttttagaagaatccttgatctcctgacgcagggaacttaaagactgacgtacttcgatattttgatttaatcttttacataaacgattgatcatatatacattccttttctaaataatgtgtataaggaaaagtccttaaaaactataaaaacagtataccttattgaaataatttttgcaaaaaaagtgaaaatcatgctataataatacgtaactaagagaataataggtaaggaagtatatgaaacatataacgatcaagagagcagagcaggcagatgtcgatgcgatcatgcaattgatgcaagaagcagtggatactgtgaaggtttccgattggtttctgccagataacagacaatatatagaagaacacataagcgaccggggatttacattgaaggctttatcaagtaacaatgagatcttgggcttttttattgtcgatcttccgggagagtcaaaacataatcttggatatgatctgaattatgacgatcataagatacacaaagttgcacatatggactacgcagttgtgacaagtaaagcaagaggtttggggcttcagagaagatttttcaaagaggcagagaaacaattagaagacacgatatatgaatacttccttggaaccgttcatccggataatatctacagtcggacaaactttgtcaaagcaggttacagggaagcaagacaaatgtcaaaatatggtggtatgcaacgtatcatcatggaaaaggagaaatgactatgagtgatcagtatgatgttattatgatcggagcaggaccttctgctatattttgtgcttatgaattaaagagaaataagccagatatgaaagttcttatgatcgaaaagggacgaaggatcgaaagaagagcctgtccaaaacgaaatacaaaggtatgtgttggatgtaaaccatgctctatcacaacaggatttgccggagctggagcattttctgacggtaaattatctttatctccagatgtaggagggaaccttccagagatattaggctatgacagaacgatcgaattattaaaagaatccgatgacatttatttaaaattcggagctgatgagaaagtatacggaattgatgaagcggaagagattgcaagcatccgtaagaaagcaattcaggcaaacttgaagctgatcgaatgtccgatcagacatttgggaacagaagaagggtacaagatctactcaagacttcaggaacatttattaaatgaaggtgttgatatgatctttgataccatggtcaaagatatcatcattgaagattgggttgcaaaaggtgttgtcacagacaaaggtgagacatatacagccgatgagatcgtagcagccgtaggacgagaaggatctgaatggctaagcggaatctgcagaaaatacgacattgaaacacaggtaggaaccgttgatgtcggagtccgtgtagaagttcgagacgagatcatggaagaattaaataaaagtctttatgaagcaaaacttgtttattacacgccaacattcgacgataaagtccgcgtattctgcagcaatccatcgggagaagtagcaacagaatattatgaaaatggtctggcagtggtaaatggtcatgcatacaaagcagacgaatacaagacaaacaacacaaactttgcattattagtatctaagaactttacaaaaccatttaaagagccgattcaatatggaaaacatatcgcacagttaagcaacatgctttgcgatggcaagatcttagtacagagatttggagattttgtgagaggaagaagaacaaccgaagaacgtctgataagaaacaacattacaccaacattaaaagatgctgttccaggagatctttcactcgtattcccatatcgaatcatgaaagacatcgaagagatgatctatgcattagatgaagtaacaccaggtatggcaagtgatgagacacttctttacggtgtagaagttaaattctattcaaataagatcttaacaaacaaagactttgaaactaatatcaaaggacttcgcgcaatcggtgacggagcatctgtaacaagaggattacagcaggcatctgcgaatggattaagcgttgcgaagagtatcttaaataaataaaatatcaaataaaaatattaaaacaaaaatccctgacaggtttctaaaccattagggatttttctgtttgagaatcctgcaaagaatgattcttccttataaaaaaattattttttgaatttaggatgtttttcatagaaagctttgttcgcctgctctcctgcaaggatcaatcgatgaagtccttctttaggacataaagttccagtatatcccatcatggaaagaacctgcatgatatgtgtgtagtatacaccagtactttctttggatacttcataaagctgatccatcgtgatcggatattcatccatcaatgactgataagattttgtgacagcatcggataataacataaaatatgaacattcgtctgtgtctcctcatgccatgcgtttgcctcgacggcaggaatcgcatgaacaccaagctctttcccaagtcttacagcttccggaatggaatgtgttgattcgtggtcagagattgcaatataatcaaggccgatacgtttcgcataaggaatgatctggtcaacacgcatagcaccatcagataaaacggtgtgacaatgtaagtctgctttcatataaaaatacctccaaaatatttattccattttctttaagatcgttaaaatattagataatgactgatgaaataattcctgatcttcttttgacagtgattcaaaacgtttggaaaggtattctttgacaagcgctttttcctgaagaatcagctggtttcctttctctgtgagttttacataaaccatttttctgttttcatcacttctaaaacgtgtgacatactcatccttcacaagtggagaaacggctcttgtagcctgttctttagatgatgccagataagaagataactgtgacatattcaatgaacgacctccagacagtgcaaataagataagaatctgtgttttggtaagatccatggaaggtatgtcgatcgtgtttaaaagaaatttctgacagattggaaaaatttcaaaaagtgcagaaacatcattcaatgtaaatccctctctttcgatgtttttctaactaaaagtataccactttatgaataaaaatcaataatcaacaaaaatcaatatttgacaaaagtcaaataaaaagataaaataggagaaacactataaaatgaccttgatcaaaggaggtaacctatgagtgaaacaacaacacagatgcaggattttctgacacgccaggcgaaagtctgccatgataattgtgagatagagaaagatctgtacaaagagctgggagtgaaacgaggactcagagatgtcgatggagtcggcgttcttgcaggtcttacgaatatatcctgtattcaatccagtgagatgatcaatggagagaaagtaccttgtgaaggaaagttattttatagaggatataatatatatgaattagtcgatggatttatgaagagaggcgaatttggatttgaagaaatcacctatcttttactatttggaaaactaccggatgaaaaacaattgaaagaattcagagaaattttggcacagagtatgacacttccaaagaatttcacaagagatgttattttaaaggcaccatcgaaagacattatgaacacgttgacaaagagcattttaacactagcatcgtatgatgataaagcatctgatatttctatggaaaatgtattaagacaatgtctgatgttgatcagtgttttgccgatgatggcagtttatggatatcatggttacaatcattacgtcaatgatgacagcctgtacatccatcgtccagatccaaactgttccatggcagaaaatattttaagaatgctgcgtccagacaaatcttatacagaattggaagccagagtgttagatattgcactcgttcttcatatggaacatggaggaggaaataactcaacatttacaacccatgtcgtgacatcttcaggatcagatacatattcagtgatcgcagctgcactttcatcattgaaaggtcccaaacatggaggagcgaatatcaaagttgttgagatgatgcaggatttaagaaaaaatgtggatgatatcagtgatgaaagtcaggtagaagaatacttaagaaaactgctgcacaaagaagcatttgaccaaaaaggactgatctatggaatggggcatgcagtatatagtatttcagatccaagagcgcagattttcaaagcttttgtaaagaaactggcccttgcaaaagaaagagaaaaagatttcgaactctattctatgattgaaacattggcaccaaaagtaatcgcagatgaacgaaaaatctacaaaggggtcagtgcaaatgtcgatttctacagtggatttgtgtatagtatgttagatatcccattggaattgttcacaccgatctttgcgatggcaagaatcgttggatggagtgcccatcgtttggaagaattaacaaatgtggataagatcattcgtcctgcgtatcagagtgtacaagatgagaaagaatatattgagatggaagatcgataaaaaagagggattccctctttttttatgcaaaaatataagcttataaaatgaggaaaaccggagacgaggagggtctccggtattatgaaaaagtatgaaaaaaagttttagctaagtaagtttgtttgttacttgctatggttttagtatactcagtaaatgtgaaagaattgtgtctaaaaaatgatgaatttatgttttttggtcatattttgagaaattcagtgattccatatgcaactccgtccttgtcatgatgttttgtgataaaggtcgcagcatccttacattttgaagaagcattttccatggcaattccgataccagcttcttttaacagatcaatgtcattatcaccatcaccaaaggcagcggtttcttcaggttttagattcaaatattcccgaataaaacgaagtccggaatgttttccggcatctttatgagaaatctcgatcagctgcgaaacagaagaagtaatatagatctcatcacaattatatttaagttcattccaaatgagctgcttttgctgctcgccagagacaacaatatccatactgtcaatatgatcaatatgttctcgaataaaagaaataatatcatcaataggaattcttgtagattggatgtaaggaattgcttgtggagttgtaccataggaaacaggatcttccacataagctttcagggcataagctttgccatcaataaaaacttcaagggcagtctcatgctgtttagcaatctgaattatacattcaacggaatcaggtgtcatcttatattcatgaagacaggtgcttgtaggaatatggtaaatggcagcaccattagaagtaattgcatattcaattccaggcacagcaagaacatctttaggcagcgtatcaaaagaacgtccacttgcgatcacaatgtgaacaccattttcaattgcatgacataaagcattataatttccgtcagaaagccgtccacttgcatttaatgttgtacggtcaagatcaagtgcaatacattttatattcataagaaacctccagatttcgcatttgttatacatagtcgatattgtgtaatatattttacacatatgaaaatattgtatcttttctttgaaacaattacaatatacgaaaggaggaaaaataaaaatgggaatgacaacattatgctatatagaaaaagataacaaatatctgatgctgcatcgcatcaagaaagaacatgatatcaataaagataaatggatcggagtcggtggtcattttgaacatggagaaagcccggaagactgcatgtttcgtgaagttatggaggaaacaggactaaccccattgtcatatagattttgtgggatcgtcacatttttgtccgatatgggaactgaaaaagaagcatgggaatatatgtgtttataccatatcgaagaattcaaaggcgagatcaaagaatgtgatgaaggagtactagaatgggtagacaaagaaaaaatattagaccttgatctgtgggaaggtgacaggttatttttacgctatatgcaagaaagaagatcatttttttcgttgaaattggtatatgaagaaggaaatctggtgcaagcagtcgtagatggaaaagacttggaattttttgatatcttagatgaaaatggaaacaaaacaggaaagatcaaagagagatctttggtccatgaagatggagatatccatggaactgtgcatatctggatcagaagaaaaacagaaaaaggatatgacttgttgttacaaaaacgaagcaaagaaaaagactccttcccaggctgctacgacatctcatccgcaggtcatatcagcgcaggtgatgaaccattagaaaccgcattaagagaactagaagaagaactagggatcaaagcagaaccagaacaacttaaaaaagtatgtatgcatgaaggaagcatgaatggaaacttctatggaagagaatttaagaatcatgagatcagcacggtttatatgtatgaagaaacagtggatattacaaaacttaaactacagaaagaagaagtcgaagaggttatgtggatggatcaagaagaactgattcagaaagtgagagatggtgggattccaaattgtatatacttggatgaagtagagaagttttaagttgtagttggccaactgtagattttgagtatatgataaaaaataaagaagcaaccgacagtgcagcggtgaaattttgctcatattttgaacaaatcgctgatccgcccaatttcctacgaaaactcgctctgaagttttgttcaggttaatagactttgaagctcagacattcgtccaattgggctgcgaatttattcaaaatatggcaaaattccaatgctgcgctgtcggttgcttctttattttttatcatataccagaagtctaaagtgtggacaattacaagattgaaaaacttaagtgggtggatgtatgttaaacattatcgttttttattttgacagtggcagacagatactattattgccaatacagtaaaacatacacactgtgtagtggtttgaatagtgttttgttgtatgagtcagaaagaagataagaagaactatttataaggatccaaggtgacaacatgagcactttttgaatgcgttttttacaaattcgcagcgccctgtggttgattgtctgaccgtagctgcgggcattttggctcgcagcgagggagacaatatgtaatgacccccaagtttgtaggatcgtggatttacctgtatactatgaattggaaactaacaatggtaacagggattaccgcatacaaattggaggtcattatatgaattataacacagtttacgtaggaatggacgttcataaggaaagttttactctttgttcttgcaaatatgaagatgaaaaggcatctcattaccagagaacaccagccagttacaagaatgtattaagatatcttgcatttcttcgcactatatatggagaggatacaagatttgtgtgtggctacgaagcaggatgccttgggtattctttgtatcatcaattggaaaattttaatgtggaatgtgtgatccttgcaccaactacaatgctcgaacaacgaagcaaaagacggatcaaaacagacaaaagagatgcggagatcattgccagatccttggcacagcacaattacagtccggtacatattccaacggaaacagataatcagacaaaagaattcatccgtatgcgtgatgatcataaagcggaattgaaaaagatcaaacaacagatcctttctttctgtttacgtcagggttatcagtatgatggaagtggtaactggacagcaaaacatgtgaaatggctgagatcattaaaaccagcagggctttacaaagagatcctggatgaatatctgctgacttatacaattctgacagataaactgaaccgtttggatcagaggattgaagaactagcatccaaagaagagtataaagaatctgtcagtaagttaacctgttttctaggaatcaagacacatactgcgttatctgtaattgttgaagttggagactttcagcgttttgtatctgcacgaaagtttgcagggtatcttggattggtacctggacagcattccagtggcgatgacagaaacggacttggcattacaaaagcagggaacacccatgtacgcagactgttggtagaatccgcacaaagttatacccgtggaaagatcggatataaatcaagagtcttaagatcacgacaggcgggaaattcaccgcaggtaatcaattatgcagacagggcaaatgagcgtctgagacggcgctattataagatggttctgaaagatggcaagaaatataatattgcaaaaacagcaattgcaagagagcttgcttgtttcatatggggaatgatgacagataatatttactaatataaatataacacatcgatcaccatatcaagaccaagccgccaaaggcggtactgtgtagtcttgacatactgatcgatgtgctagaaatgataatcaagatgatgtaagccggtctctgccgcatacatcatccagcctgtaattaaagttgcaactgaaggcatcccgaaagagtttcgaacatgtttaggtttgaactatctacgaggaaactctgttggcacagtaatatctgtgatccacgtgagggagacagctagagttcgcggcggaccattgacctgttggtaaccaatccacgtatatcagagtggccaatgccgggaactgatacatcggaactctttctggatatcttcagaaacaataaaataaaaatttgttgtaatttctgttaatttactattgacaaaggtcattacatatcagtttccaaaggaacaggcacggatcagcgatttgtaaaaaacgctttcaaaaatgcggagtgtcaccttggatccttataaatagttcttcttatcttctttctgactcatacatgaccaacactaccacttcaaatcaagattgtataaaaacgaataatctatagaattcttactaaattatgctataatatacaagattaatcaaacagtttcaaaatgaaagagggagtatcaaatgaaaaggttattattagttttaatgctgattctgggagcagtaatgatcacaagccgtccggtggcgacttatgcatatacagatgaagaaaagcagcaggcgaaatcatggctgtcttcgcatggttatccaccaacaagagcaggggcagaacaggcatatcaggattatatggatggaaagattgatgttccagaagcagatgcatatatgggaaagaaccagaaaaatgagatagaagaaaagaaaaattcaactgtgaagacagaaacaaaaaaagataaacaatctaaaaataccaataaaaatagtacaacaaaacaagaaaattcatctacagaacagacaaacaacagtacaacatctgcaaaagagtcaacaacacaaggaacaacagaaacaacaacgaccaaagtgacaacagaaacaaaagaacagaaacaacaaaaagaagaaaaaaagaaaaaagagcagaaagaaacaaagaaaaaacacacaacagggattgcgatcggagtagctgcagttgtgatttttgctttacttgtagtatttatgcgaaagagaatgtaaaaaacgctatgctgaagtgatagaaaattcacttgacacaacagttagcgagtgctattctataaataaattacataacgtcttcagggcagggtgcaagtccctaccggcggttatagcccgcgagccttatatggcatgacttggtgagattccaaggccgacagtacagtctggatggaagaagatttaagaagtgatattgatcatcatgtcctgggatttttataattccaggattttttatttcaaaaagaaatatcaagatatcaaaaaggagttcctgaagaattagaacaaagatcaggaactcctttttatatttctgatttcaataccaatcaaaatccaacctcccaaaatcaaagaacctgaagggaagggagaaaaatatttgaaagaagaatatatgcggcgtgcgatcgaacttgccaagaaaggctgtggatataccaatccaaatcctttagtcggagcagtgatcgtaaaagatcaaagggttattggggaaggatatcatgagaagatcggcggattacatgcagagcgaaatgccttaaaaaactgcatagaagatcctgagggagctgagatttatgtaacattggagccatgctgccattatgggaaaacaccaccatgtacggaagcgttgatcgaagcagggatcaagaaagtatatgtcgggaatttagatcccaatccgaaagtggcagggggcgggatcaagattctgaatgatcatggaatagaaactgagacaggaattcttgaagaagagtgcagacagttaaacgatatattttttcattatattcagaatgatattccatatacagcactaaaatacgcaatgacattggatggaaagatcgcaacggcaactggtgaatccaagtggatcacaggagaagaagccagaagacatgtacatacattacgacatcagtatgcagcgatcatggcagggattggtacggttttagcagatgatccgatgttaaatgcacgaatcgaacatgggaatgatccaattcgtgtgatatgtgattcaaacttaaggatttcggaaggatcaaatatcgtaaaaacagccagagaaattccaacgatcatcgctaccataagtaaggatcaagaaaaaatagcaaaattagaacaaaaaggatgtaagatcttaaaaacgtcagagcaagatggaaaggtcaatgtcaaagaagttttaaaacagttaagaaatatggaaattgacagtgttttagttgagggtggtggaatcttgaatgaatctttgatcaaaaacgactgtgttcacaaagtttacgcctatattgctccaaaattatttggaggagaaaaggccaaaacacctgtagaaggcaaaggaatcgaaaggatccaagaagctttggtatttgatgaattaaaggcaacaccacttggaaatgacatattactggaaggaaaggtgagatcatgtttaccggaatcgtagaagaattaggaacagtcatatccctgaagcgaggaagcaaagcagcagtccttacgatcaaagcaaatgttatttttgaagatcttaaattgggagacagcgtagcagttaatggggtctgcctgacagcgactcacattagcggcaatacatttcaggcagacgtgatgaatgagacattcaaccgaagcagtcttggaagtttaaaaaagggatctgtcgtcaacttagagcgagcgatggcagccaatggaaggttcggaggtcatatggtagcaggccatgtggacgatacaggggaacttgttagtgtaaaacaagatgataatgctgtatggtttacgatcaaagccccagaaaatatcatgaaatactgtattgaaaaaggatcgatcgcactcgatggaatcagcctgacgatcgctaagttaagcgatgataccatttccgtatccatgatcccacataccataaaaaataccaattttggatataaaaaaccaggagataagatcaatctggagaatgacatggttgggaaatatatagataaactgctgcattttgatcagcaggaaacaaacgacaaacatacaaacagcaccttaacaatggaaatgttaagaaatgctggattttaataaaaaacgaggagggaaaagacaagatgagcgatgtagtatgcgaagtaatcgcacagcttccaacaaaatatggaacatttgaggcacatgggtatgtagaccagagaagtggggaacatcatgtagcactggtcaaaggagatatcgcagacggagaaccagttttatgccgtgtgcattctgagtgcctgactggggatacttttggatctctacgctgtgattgtggagaacagcgaagtcgtgcaatgcgtcagatcgagaaagaaggacgaggggttttcttatatatgcgtcaagaaggacgaggaatcggattgatcaataaactgaaagcttatgtattacaggaacagggaatggatacagtcgaggccaatttagctcttggatttaaagatgatgaacgagattacagtgcaggagccatgatcttacaggatttaggaatcaaaaaactgcgactgatgacaaacaatccaaccaaaattgacggattaaatgaatatggactcgagatcgtagaacgagtaccgatccagatgccaatcaatccatttgataaatattatatgcagacaaagcaaaagaaaatgggacacatgacaacatacgaagtttaaattaacagaaaaattaaaaaaattaaggtcccagggaccttaagattaacgaaattaacgaagaaaaaaggagtaattaaaatgagagtattagaaggtaaattagtagcaagcggattaaaagtaggaatcgtagcagccagatttaatgaatttatcgtatccaaattagtatccggagctttagacggattgaaaagacatgatgtgaaagaggaagatatcgatatcgcatgggtaccaggagcttttgagattccactgatcgcagacaagatggcaaaaagcaaaaaatacgatgcagtgatctgtcttggaacagtgatccgtggagcaacaagccattatgattatgtatgtaacgaagtatccaaaggaatcgcacaggtatcattaaatacaggaattccagttttattcggagttgttacaacagaaaatatcgagcaggcgattgaacgtgctggaacaaaagcaggaaacaaaggatatgactgtgcattatctgcaatcgaaatggtacagctgatcaaagaagtagaagcataaaaagaatcagaaattaaagcaggaagttagtatggaacaatattatttaggatttgacgcaggaacacaaagtgtaaaaacagcagtttatgatattgatatgaacctgatcgtgcaggataccaatgcaacaatcttaaattatccacatccgggatgggtggaaatggacgcagaccagtatcttcatgcaacggttacagggatcagaaactgcgttacaaagatgaaagaaaagaatctggatccagacaacatccactctatttttggagatgggatcatctgcgggattgtcggtgttgataaggattgccatgcgatcacaccttacatcaattatctggattccagaacaaaagaagatgttgaggaactagcatctcatcattatgagatctgggcgaaagagactgggaatcctcagccaaactgtatgtttccagcgatgtttgcacgttggatgatgaacaattgtgagggctttaaagaaaaaggcagaaaattcatgcacaatgccccatatatcctggccaatcttgcaggactgtctgcagaagatgcatttatcgactggggaacaatgtctggatggggactaggataccgtgtaacagagaaaaaatggtccaaagaacaattagagatccttggaattccaatggaaatgatgccaaagattcaaaaaccatgggatatcattggaacattatcagagacatttgcaaaagaaaccggattgaaaccaggaatcccaatctgtgcgggagccggagatacgatgcagtctatgatcggatgcggagtgatcaaaccagatcaggcagccgacgtagcaggaacatgtgcgatgttttgtatcgcaactgatgggatcaatgaagaattaagcaaaccagaaaatgaactgatctttaacagcggaactttagaaaatacatacttttattggggattcataagaaccggtggattagcacttcgttggtatcgagataatgtatgcaacgaagcaggaaatggagcatattttgatgaattaaatgagaaagcacaaaatgtgccatgcggatccaaaggagtcctgttccttccatatttaacaggaggatttggagaaacatccaatgcaagtgcctgtttcctgaatatgacgatggacacagatcagggagtacagtggcgtgcagttttagaagcgatcggttacgattatatgagtgtgacagatatttataaaaaagcaggcgtgccacttgaatttatgacgatcacagaaggtggaagtaattcagaagtctggaatcagatcaaagcagacatgttaggatgtaagagtgccacattagaaaatgcacaaggagcagttcttacagatgcagtgatcgcagcatatgcggtaggagatctggaagatccaagtcaggtatttgaaaaaacgagaaagatcaagaaaatttatgaacctgatccaataagaacaaaatactatcgcagtatttatgaacaacaaagaaaactaattaaagacgatatggcagcagtttttgagactttacaccagatcagtaagattcaagaacaaagcaatgattaaaaaaatgaaaaggcttctttacaagaggcctttttttcttgtataataaaagataaagtatataaaaataagttataagcaactaactttgcagatgatttttgatcaattagatttcaaggaggaaaaagtcatggataacgaaaagattgaaaaattacaacagatgattgatgaaagtaatcatatcgtattctttggtggcgcaggtgtttcaacagagagtcatattccagactttcgaagcacggatggtttgtatcaccagacttataaatatccacccgaggttatggtaagccatacattttatacacagcatacggaagaattttatgatttttataagaataagatgatcttcttggatgcaaaaccgaataaggcacatttaaaactggcagaaatggaacaggcgggaaaactgtctgcgatcgttacgcaaaatatcgacgggcttcatcaggcagcaggaagtaaaaatgtctttgaactgcacggcagtgttcacagaaactattgccagaaatgcggcaagttcttcgatgtgaattatgttgtgaatgccaaaggagtcccatattgtgacgaatgtgggggaatcatcaaaccagatgttgtattatatgaagaaggcttagactctcagacgatcaatggggcagtcagagccatttccaaggcagatatgctgatcattggaggaacatcactggttgtttatccagccgctggaatgattgattattttaaaggaaaatatcttgcagtactgaatcgtgatgcgacaagcagagataaacaggcagatttgtgcattacagacccaatcggagaagtactgggaagaatcagggtataaagatgaagaaaaaggatatgatcttgatcgtagcagtactggcaatttcgctgatcagttttgcagcgatcaagatgacacaaaaagacggaaaagaagtgatcgtgacagttgaaggaaaagaagtgtacaaaacatccatcaagaaagatcagatctatcaaattccagaggaaaatggcacgaacgtcatgcagatcaaagatggaaaagttacaatgaaaaaagcagactgtaaagaccagatctgtgcagaccataaagcaatcgagaaatcaggagaaacgatcgtatgtctgccgcataaagtagtgatcgagatccggttagaagatggcaaagaacaggaattagacggggtaacacaataaacatcagatgagatagtaaacaacaggagaaataaaatatatgtcaacaaaaagattagcgacagatgcgatgtttttaacattggcacttgttgtatcctatatagaagtattgattccggtaccagttggaattcccggagtgaaattaggacttgccaatggagtgatcatggttttgttattctttacaacatggacaagaacgcttgagatctcagtgatccgagttgtactggcaggattcttgtttggaaatccaatgacgatcgcctacagtctggcaggagggatcttaagtctggtcatcatgggacttctaaagaagatcgaaggattctcacccattggaatcagcgttggaggcggagtagcgcataatatcgggcagctcagtgttgctgttttcttaatggagaatacaaagatttattattatgcaccagtattactgatcacaggaacgatcgcagggatcatcatcggagtgttaagtggagtgctagttaagaagatcccgccacaactatttcgataaaagatttgaaatttctacaaaatcgtggtactactatatgtatacactttctagcaggcaatgattttgaagaaaggagtcacaattgagaacaaaattaaatgagatcataaaaaatgggcatcttggcatgattgcagtattttttatagtttatatgatcacattttcctacattgaagatcgagatgtgcatcattacatcatacatacaacgatagatgatcagataccattctgtgaatatttcatcgtaccatatctattatggttcttatttgtagcagttacagttttttattttatgttttttaataagaatcaatggaaagaatattatcagctgatcataacacttggaacaggcatgaccctgtttttgatcatctcattagtatttccgaatggacaggatctaagaccagttcttactggagacagcatttttatcaaagcagtacagatgatctatcacacggatactccgacgaatgtacttccaagtatccatgtatttaactctctggcatgctgcgttgcgattttgaagaatcagagaaaatataagaaaagcaccgatacagcatgtgttgtcttaacgatattaattatcatgtcgacgatgttcttaaaacaacacagtgtggtggacgtagtgctcgcagccctgatgtatactggatgttacaggatcatctatgggaatgaattatggtcacagaatgcaatttagcacgtctattttcagcgatcattcgtaaaccacgcttgacacgaccaagaaagatttgctataaataccagagagaaaccgcagaaattggagtagagaagaatgagaaaaaagatttggatgatcctggtatgcatcatatccatgagtttttgcatggcaggatgtactggcaatacaagcaagaagaaatcgaatggaaagataagaattacaacaagtttttacaccatgtatgattttgcaaagaagatcggtggagacaaagtagaagtgatcaatttggtaccggcaggaacagaacctcatgactgggaaccatcaacgaaggatctgatcgagatggagaaatcagacatcttcatttataatggagccggcatggaacaatgggtagatgacgttttggaaagccttgatacggaagaacttacaagcgttgaagcatccaaagggatcaagttactaaaagatcaggatgcacatgaacacgatcacgaacacaacagtgagaatgatccccatgtctggttagatccacagaatgcaaagtatgagatgaacaagatcaagaaagcattgatcaaagtggatgcagagaataaagattattacgaagcgaattataagagatacgcaaaagaatgtgacaaattagatacattatataaggaagaaacatccaaacttacaaagaaagaacttgttgtggcacatgaagcatttggctatctatgtcacgcatatgggttagaacagatgggaattgagggattatccgcagacgatgaaccagatcccaaacagatgagcgaagtgatccgctttgcaaaagaacatcaggtaaaaacaatcttttttgaagaactggtgagcccgaaagtagcgaaaaccattgcaaaagagaccggagccaatgcaaagatgttaaaccccctggaaggactaagtaacaaaaaaatcaaagcaggagaagattatttttccgtaatgaaacaaaatctcgctgcgatcaaagaggcattaagcgaatgagtgaatcaaacacaaaacagatgatacaattaaatcatgtaaaattcggatacagtgatacggaagtcttagaagagatcaatctgacgatccatgaaggcgaatatgttgttctgactggtgaaaatggaagcggaaaaagtacacttatgcgtctgatcttaggtgaaatgaaaccagatgaaggagagatcatcctgatgaacaacgatccaagattaaagaaacggatcggttacgtgtcacagaatgggatcagtaagaaccagagcttcccagcaacggtagaagagatcatgatcacaggactttatcaggaacttggactgtttcatctgccacataaaaagcataagaataagatcaaagagacactaagggattttggaatggaagaattccttaagagacggatcggtgaattatctggtggacagcagcagcgagtgatgatcgcaagagcaatgatcggagatccgaaacttctgatcttagatgaaccaacaacgggagtagatgcaagatcaacaaagatcttgtacgatatgctctatgagatcaatacaaaatacaatacgaccatttttatgatcacacacggaagactgcaggaatgtaaaggatgtgatcgtattttaagaatggatgaagggaggatcgtggaagaatgatcgagatgttacaatacggatttatgcagcgtgcatttattacaggaatcttactggccgtgatcgcaccattgatcggaatcacgatcgtcttaaagagaatgtccatgatcggagatgcactctctcatgcatccctggcaggtgttgctctgggcttgttattagggatcaatccaatcttaggagcaatggggatctgtctgtttgcagccctgggagttgaagcgatccgaagaaagatcccaagatattctgagatggcgatatcgatcatcatgtcaacagggatcggacttgccggtattctatccggattcgtaaaaaacggaacgaactttaacagtttcttatttggaagtatcatatccatcagcaaagacgaactgaagatcgtatgtgtgatcagtgtgttagtattgctctgtgtattgcttctatataaagaactattctatatcggatttgatgaaaatgcagcaaggatcagcggtgtacctgtcaagacgattaattttatctttactttattgaccgcattgacggtatcgatcgcatcaagaacggtcggaacattgatcgtctcatccatgcttgtgatcccgatcgcatgcggaatgcaggtaggacgaagctacaaagcagttatgatcatcggtgtgatcacagcattggtcacaacagtgatcggattaacactgtcttattatgtaggtcttaagccaggaggaacgatcgtactgctcgaggtggtatgtttcctgatcctagcactgataagcagatatacgaagtaaatcttttgacatttatcagaaaattttatataataaaaagaaggcatgcataacagaataaaactgcatgccttcttttttggaaaaaacaatgaaaggaaaggcaagtcaatgattgttcagctaatagaaaatatatatcagtttttatggggagaatggattcatgttccgttaccaggaggtggaagcctgggactttcgctgctcattatattgctgcttccagcaggtatcgtttttacgatcaaaacaaaatttttaccaatccgtctgttcccggatatggtcaaagcactaacagcaaacaataagaatggaaaagatgaaaaaagcagtctttcttctttacagaccttgatcgtatcaacagcaacacgtgtcggaatgggaaatctgacaggagttgtcgcagcaatatccgcaggtggagcaggggccgtattctggatgtggatcacagcattgcttggatcatcgacagcctttatcgaagcaactcttgcacagttacataaagaaaaagaccccctgtatggtggatatcgaggaggaccagcctattatattcaccactttatggaagagagacaaggaaagaagaaaacacacacactgattgctgtcttatttgcgatttcaggattgatctgctggtgtggaatcagtcaggtggtaagtaattccgtggcagaatcattccacaatgccttccatattccaacactttatacaacgatcgtgcttgttattgtggcagcagtgatcgtactaaggaagaatgcaactgtcaaagtattagatatcgtggtaccgatcatggcagtcatttacttcgggattacaatttttgtgatcctcacgaatctgccaagcattccaggggtttttgcaagaatcttcaaagaagcctttggaatccgtcaggtcgcagccggagggtttggagcagttcttatgaacggagtgaaacgaggattattctccaacgaagcaggatcaggatccgcaccatgcgcagcagccgcagcagactgtgaacgcccagcacagatgggactggtacaggcattaggagtttttatcgacacgatcgtgatctgtagctgtacggcaatgttgatgttattagcaccacagaatctgaccaatggattaactggtatgaacttgttacagacagcaatgaactaccatttaggaggattcggagttgtatttatcgcagtgatcctctggatgttcagtttctcgacattccttggaatcttattctatgcaagatccaacgtcgcctacctgttcggtgacaaatggggatggcagacagcctataaagtattagcacttgtgatgttatttatcggaggaatccagacctatacattcgtatgggatttaggagatgtcggaattgggttaatgacgatctttaatatcttcatcctgtatgcaatgtcaggacaagcaatcaaagagttaaagaactacgaagaaacaaagaagaaatcaatcgaagaaagagcatatgcattgcaggaagatgaataggaagtaaataagtgaaaatgtccaatgaagcgattataaaataaattgctgcattggacatttttaacataaaataaattgtcagttacagattacacaaacaatttcttacgtgtcctaaaataagccaccagaaccatcgttccagtcaatacccaagaaatcggatagatcgccatcaaaagtttataatcatggaaccagttacagaccgttgcaagccagatcaaacgtaatacacaagatccaaacactgtcagaatcgcaggagtcatggaacgtccaaatccacgcagacacccaccactgatttcataagaacttgtcagacattcgaatgtcagaacgatcaaaaaacgaagctgagcataatgatagacagatggatcacttgtaaataatccaataaagaatgtacggaatacaacaaagatcgtactaaggattccacaagagattacactgcacaacattccaagacgaaaaatcttcttacaacgctcctcatccttcgcgccataattctgtccggtaaatgtaaccaccgtctgagcaaaggcattgaccagataataagcaaaatactcataatttaattccaccgcagaacccgcgatcccgccagctccaaaactgttgatcccagattggatacagacattggcaagagagaaaaccattccctgaagtcccgcaggaaccccaatcttcaggatcttagaaacggcatcatgatcaatcgtcaaagacttaaaagacaagcggatcggaagttcttcatgcgtcagaaaataaagaatctgaatcgcacttgttgcattcgcaccaaccgtcgcaagtccggcacctgcaacacccatatgaaatacaacgacaaatagaagattcaagatcacatttacaacaccagacacgatcaaagcatacatcggacgacgtgtatctccgatactgcgaagaatggaagcaccgaaatcatataacataaaaaatggcattccaagaaaataaatccgcagatataacgttgcaagatgaatgatatccttcggtgcacccatcagcaaaaggatcggatgagccacaaactgtccaagaatcagtaaaaacacaccactaagcagtgcaagagacacagcggtatgtaccacacgcgggatccgcttcgtatcattctgtcctatataattggcaatcacaacattagaaccaagagaaatcccagaaaacaatgtaaccatcaaagcgatcacagaactattactaccaaccgccgccaaagcctcactgctcgcaaaccgtccgacaacggcagtaccgaccgaattaaaaagctgctgtaagatactacaggcagcaagcggcatagcaaacattaacatcttatcgaataaacttccatgaagcatatccatcttcacggactgtttcgaagaattcttcatatacaataccctctttcaaaaaactatacagattctaatactttttgggaagattatcaagatgattccaggaaaaacaacgaagaaagatgtatcaaattcgaaacatttcttgtataaaaaaagcagaatgatatactaggatgagatatcaagaaaacatacaaaagaaagaaggaaaacaccatgcaaatcagtattctgctgctaaaacagatcgtacaactattcctgatgatcctcatgggttacattatggtaaagatcaaatttttaaaagaagaagacagcaaagtgatctcaaagatcatactctatctgatcgtaccatctgtgatcatcaccgcatttcaggtagactataccccaagcattatgaaaggactggcagttgcatgtatcgcatctgtgatcctgcagtttttattactgtttgtcacatggatcatgggaaaaatgtttcatttaaacacggtggaatacacatctgcctactattccaactcaggcaatctgatcgtaccattagtcacctatatcttaggaaaagaatgggtcatctacggctgtgtcttcatgagtgttcaattatttttcatctggacccactgcaaatgtaagatcagtggagaaacagagatcaatttaaagaagatcctgttaaatataaacatgatctctgtattcgcaggagtattcttattcttcacgaagatcagatttccagaaatcataggaaataccctgtcatccgttggaagtatgatcggaccattaagtatgatcgtcacaggaatgctgattgcaggcgtcgatctaaagaaagtatttacaaacaaaagaatctacctggtcacattcatccgattagtgatcgaaccgatcatagcactggcagtcattattctattaggaatgaaaaactggcacccacaggcagaaaacatcatcctgatcacatacatggcagcaatcacaccatgcgcctcaacgatcacacagatgtgtcaggtgtacggaaacgattcgaaatacgcaagcgcgatcaatgtaatgacaacattgctggcggtggttactatgccggtgtttgtttatttttatatgaatttgtaatgtaaaataattgcaagtaaaatattaacaaaaatgataatgatagtataataagagataatcaaaaagagaacttacatacaagcaggcaagttctctttttgattgtacattcttcaaaaatttataatggagtaagattttactgtctataatactccaagaaatccctcagcttcacagaagcatcctcaagcacttccacacgaggcagataaactactctgaaatgatccggatccttccagttaaatccacttccatgcacgatcagaatcttcttctcacgaagcagatcaagagcaaactgctcatcatttgtaatgttaaacttcttcgtatcaatcttcgggaagatataaaaagcagcttttggtttcactgcactgataccagggatatcacacaacgcattataaataaactctctctgttcataaatacgtccaccaggaatgatgtaatcattgacactctgatggccgccaagtgctgtctggacaactgcctgcgcaggaacattcgaacaaagtcgcatatttgataacatatttaaaccttcaatataatccctcgcgatcgccttattaccacttaagatcatccatccgatacggaaaccagcgatcatatgagacttggataaaccagagaatgtcacacagaacagatctggagccagagaagcaatagatacatgctcttctccatccatcaccagacggtcataaatctcatcagagaagatcatcaactgatgttccctcgcaatatcaacgatctgttgtaagacttctcttggataaagagcccccgttggattgttaggattgatcagaacgatcgcttttgtatgggaatttacttttcgcttgatatcttccatatcaggataccactcagactgctcatcacagatataatgaactgctttccctccagcaagcgttgcacaagccgtccataaaggataatccggagaagggatcaagatctcatccccatcatctaataaagcagacattgacagattgatcagctcactgacaccatttccagtataaatgtcatcgatatcaacatttgggatcttcttaagctgcgcatactgcatgatcgcctttcttgcagcaaataatccctgagaagcagaatatccctggcagtcagctaactgatgtctcatatcatagatgacttcatctggggttctgaaaccaaatggagcaggattcccgatatttaatttcaggatatgagttccattacgttccatgcggttcgcttcatctacgacaggaccacgtacatcgtaaagtacattatctaatttggtagatttgctaaatgttctccttggagaagtttccagatttacagcattccctccatttccagaaagccagtcagcatcgacatcaagagtttcagataagaaatgaagaatctccgcgcgaggaaccgtcttgccactgacatactggctgatatgactcttcccgaccttgactccggcagtctctgctgcatgaataagatcaacctgtttcatatgtttttgttccattgcagacttcaaacgatctgcaaaggtaaatgtctgattcataacaccctccgataaaagttcaaaacaaaattcaaagttcaaatgattttgtttaatatagcacaaaaacaagaaaagttcaatgaaaaagttcaaaaataaaagctaaaagttcaaagaaacaatatacggaataagaaaaaaaattaaagttcgacaaaaagtacaaagatttgtattgaaatttctatactttggaaagtataaataattaacacgaattgtaaaaataaatggggatgaaatagaatatggaagcaacaagattacagatgcagaacttcctaatctttttattagatctggtgggagttactgttggttattttgcagcagtatggctgcggtttggaaatattgaaacagggtataccgtgatggggaacgatacgtattatcgttggctcattgcgatcgtagtacttatgatgatctactttctgtttcgtccaaatcgtggtttttttaagcgcaaatttatagaagaaatgagaatgaatctgcagacggtcgtcctgatggcagcaggaatggcgatggtcgcattcctgattcaggatgcaaaagattactccagatttatctatatctttacttctggattcagttttgtatggatgcagatcacacatcgagcttatcggaagtattggctatcaagaagaaaggatcattcttatgcaagaaagatgatgatcatcacaacgagtgatcatgcagaagaagtgatcgggaatatcatggaagagaagaactgggacttgtggatcacaagtgttgcagttgtggacaaagatatgacaggatggcttatcaacgagattccggttgtagcacattcatatcgaagtatttttgaatatgcgatgcggtcggttgtagatgaagtattcttatatataccgatggatgacgaatttccaatcgcgatgacggtacagaaccttgaggatatggggattaagacgaatcttaacatttctcagtttcagatcaatgagaatctggaacgatcactggagaaggttggaccttatgagagtgtaagtttctctggtcataatgtatcatttgtcatgctgatgatgaagagagcaatggacattgccgggggattggttggaatgctgatcacagcaatcgcagtgatcattgtcggacccctggtgaagttagaatcaccagggccgctgtttttctcacagaagagagttgggaagaatggaaggattttcaagatctataagatccgttcaatgtatcaggatgcggaagagcgcaagaaagagcttatggcgcagaatgagatggacggcttgatgtttaagatgaaagacgatccgagaatcaccaaggttggaaagtttatcaggaagacaagtattgatgaacttccacagttttggaatgtactgaagggggatatgagtctggtagggacaagaccacctacagtagatgagtttgaacagtatagtgcttaccataagaagagactttgccagaagcctgggttgaccggagtttggcaggtgagtggaagaagcacgatcacggactttgaggagattgttcagatggatgttgattatatcgatcattggtctatctggagggatattgggatattgtttaagacagtgtggcttgttgtttgtggggatgatggggcacagtagaagtagaagagttgatgatggattaagaagggaaattcgatgtcagaagagagaaagataagaattgttcatattgcacaatctcccggaggtgtggaacgatatttaaggtccttacttaaatatagtaatagggaaaaatacgagattattctgattgtttcaaatcaatataagaggaaaaactatgtgaatttggtagatgcttttgaaaatgtggatatgatcagaagtattgatccaaaaagtgatttaaatgcgattaaggcaatacgtaagttgttgaagaaatataagccagatattgtttattgccattctagtaaggcaggagcattgggacgaattgccaacatgggattaaaaaataagtgtgtgtataatccacatggatgggcatttaatatgaggggaaataagttaaagaaattaatatatgttggaattgaaaaggtgttggcaccattttgttcaacgattatttgtatttcgggggctgagaaaagatcagcattaaaatataggatttgtggtaaaaaaaagcttaaggtaatttataatgggattgatttcgatgagtataatatggattatcatatgaatacgagagaacttttagaaattccagaagatgcatttgttgttggcatggtgggaagactggcagaacagaaagcaccagatgtgtttgtaaaggcagcaaagagaattaaagaaataataccaaaagctttttttcttattgttggagatggaccagattgggatgaagtgaagcaggaagttgatgataatgagttgacagattcatttattcttgctggttggactagaagaccgatggaatatattaagattcttgatattgcagttttaatttctagatgggaaggttttggattggtattgccagaatatatgttggcgaataaaccgattgttgcaactgatgtggatgcaattccttttattgtacaagatcatgtgaatggattgttggctccagtggatgatgatgagaagattgctgagaatgtagttgagatttatcgagatgcggagcttagggataaacttgttgaagaaggtcggagagaagttgatgagaggtttaatgttgagagagttgcaaaagatacagaagatttaatgaatagtcttgcaatgttaaaatatagaaaatattaagtaaacgaggaaagttgtaggatatagaatgattataattaaaatatggtatcatatatgggcaattgtaaaaaaatttttttacaaaattatatatagaaaaaaaattgaaattgcgaagaatgttacatggagacgtgatttttctataatggtaggaaaaaatggaaaattgcaaatcgaaaaagattgtttttttaataatggatgtactataggtgtgaataagtctgtggttatagaaaaaggtagcatttttggtgaaaatgttaaaatttatgatcataatcataaatttgcagatattactaaaagtattaaaagtcaaggatatagtaatggtatggtacgcataggtcaacattgttggataggcagcaatgtgtgtattttaaaaaatgcggacataggaaacaattgtgttataggcgcagggtgcgttatttcaggaaaaatagaagataacacaattgttagagcaaataatcaatacattttagaaacacttaagcaataggggtgtattatgataaaagtttcagtaataatgggtgtatataattgtaaaaatgaagaattgttgaaaaaaagtgtagattcaataattaatcaaacatataaaaattgggagtttataatttgtaatgatggatctacaaataatacgttagagatgctgaatgaaattgcacaaaaagattcaagaataaaaataatttcatattcaacaaataaaggtttaaattatgctttaaatacatgtttaaaggaagctaaaggaatttatatagcaagacaagatgacgatgatatatcaaaatgtgaaaggttagaaaaagaagttgagtttttggataataatttagaatatgcaatagtaggcacattagcggatgtatatgatgatggtggtatttggggagaatataaagtagaagagagacctaataaaaaatcattttattggaatagtccatttatgcatcctaatattatgatgagaaaagaagcattagataaatgtcatggatatagaattgcaaaagagacaagaagatgtgaagatttagatttatttatgcgtatgtatgctttaggttataagggatacaacattcaggaaaaattgtatgaatatagaattgttaatgatgaaaagaaaaaatatcgcccaatgaaatatcgtatagatgaagctattgttagatataaaggatataggtctttaaaaatattaaatattaaaggatttatatatgttattaagccagttttaataggtttaattccacaaaaattactatataaaattaaaaaaaagcagtattaaaattatggagagattatgaatgataaaataaatatatattttggaaaatataaaataaatactatattaggattagtatccattggtattgctttctatgttgcattgcacactaaaatagggacagcttatgaatggtattttataataccaggtttttttggtgtattacttttgattgggagacctttaaattttaacgattcaagcaacataggaccaacagtattaaactacactatgtttataaaatatgctatatcgccattattatcatgtcttggtggatattattcgtggttaggaaaatatccaggacaagaaaatattcaaaaagcaatagtattaacgttttatgaaatgataataatatttttggaaagcgtttatctaaccaaaagatataaaagaaaagaaagaaaaaatattgaaatttctaagcctttaagaggacaatttattcattggtgtataattgcaataggatttttagttttatttattatgccaagtgcattttctgattatcgttttttatttgatcagactgatttggctacaacagttaaagttgattttgctggctcaggtatctataaaacattatttatatttgcaagatatagcttagtattggtagttatagattttttttataaaagaaatttaaaaaaagatagcgtaataaatgttgttggagcgtttattccgacattgttaaattgtctgtatgtgtctaatttaagtcgtattggaatatttgcaccattattgtcgtgtgcttttttgataatcgtgttatttaatactccaaaggctagaaaaaccatattatatggaatcgcaagtataggcctagtatttattgtatacttatcgtttgttaaattttttggtgaaggacgaggagttgtttcaaatgcaacaagctttaaatggtggggagatacattgaatatgtattttacaggaataaaagaaactgctattggattaaaaacaacaaaatatgtaaatgatgtttatggaataaacagaattaaattaatgtttaatgattgtttttcaaatgtttcttttttaagtaatcttacaaatcatagtatcaatacaaataaacttttcaatgttgtatattttggtggatatatttcaattagtcagatatgtcctaatatatgtgagggtgtatattattttggaacgattttttcagtgatttggcctgctttatttgtttatttaagctactatttttcatataaaagtcatgaaaaaatatatatggattctaaatttatttgcatttatgcagcaatatattgtgggatgattttgatgttgaattcagcaatgattgtgtctaatctaattaatatatcattgttatatgcagtagttgcaataataaatagaaaaataaaaataaaggtgagataagatgaaactattatttactgttaatacatatctgcctaaacatgatggagtacaatttgttacaaaatatttggcagagggattagtaaaaaaaggacatacagttgacttgataacgagaagatgtgatgaattgacaaaagtcgaagatgaagttattaatggagtgcatgttatacgttggaaagcggatacgaagcatacgtttcataaaggtgataaaaaagggtaccaaaaatatcttatagaaaaggccgaagaatatgattgtatgattaatgttggaacccaaacatcatttgttgattggatgcttccaatcatggatcaagtaaaatgccccaaaattttgtatttacattcaatatgggattttaaatatcatagatgtgattttgatagtgttcaaaatttatgtaaaaaaatatgggcaaatattcgatggaaaatatattatttaagagcaaaaaaagtatttaaaaaatttgcaaaagtaattcagcttcataaatttgattattcatatacattttttaaacaaaaatatgggatagatagcgtaattattgagaatgctgcagaaaaagatttttttgataattttattgatttaaatataaaagtaccagaaaaatattttatcaatgtatcgaattatatggatagaaaaaatcaattagaagcattgaaaagttttttacaagcagatatatcagaagaatttgaattggtattaataggatcaagcaaaaatcaatattatgagcaattaataaaatattataatacatattgtatgaataatagtaattataaaaaggttcactttttatataatattccacgtgaaaatatatatacatatgtaaaaagagcatatgcatatataatgacaagcaaatgggaagcatatccaatttcattaatagagtcaatggcagcgagtgttccatggatttccacggatgttggaatcgtaaaatatttaccaggtggagttgttgctaaaaaacacgaagatattgtttattggattgaatttatggctaacaatatggagatagcaaaagaatttggaaaaataggtaacgaatatgcaataaaacaatttcaaattaataaaaaagtagatttattggaaaaatgtattatagatgtattagaaaaggagaaaaaataatatgaaaatagcctttttgtgtccatactttggaacattcccaaaacatatacagttgtggttaaattcatgtgcaacaaataaagatacaacatattttttatttacagatgataaacaaaaattaaattatccagataattttgtagttaaatatatgacattgaatgaacttaagaatttttttcaatcaaaatttaatttcgaaattagtctttctggagtatataaactaggcgattataaaccattatatggatatttatttgaagatttaataaaagattatgatgcatggggatatttagatgtgccagatgagatatgtggagatgtatctgcgtttgtaaatgaaaaagtatttttgaaggctgataaactaatggttagaggtcacatgactatatttaaaaatacaccagaggttaataagcgattcatggctgatacaggagaaaaatttaattataaagatattttttcttctgaacacttttttaattttgaggaaatagcaaaaggtagtataagttggatatatataaataataaatggaagatggatttattaaatgatgcagtagcagatgtttcaggattattttatgattttagaagaagttgtgtatcagagaagttagaatattatagaccatcgaaggtaccatcaatttatgcacgagaaaatggaaaaatatatggatattttttagaaaatggaaaagttattaaaagagaatatctttatttacattttaaaagaagaaaaatggaaattaatgttcctcttgattcagatcaatatttgattgtacctaatggatttgaaccatatacagaagttacagcagatgtaataaaacaatatgcaaagaaaaaattattttatcctgttttttgggaagaagtaaaaaaaagtatagtaagaaaatgtactaaaaataatgggagataatattttagatgaagaataagtcaaaaagattgataaataatacgataatattttttatcggtagtttaggatcaaaatttatacaattttttctagttcctttatatacatatgttttaactacagaacaatatggagtaacagaaattgtattaacagcgtctaatgtattaatgccagttttttcactttctatagctgatgggttattacgttttggattagataaaaattggaaaaaagaggatgttttaaaaacttcattagtaattgtttttattggaacgatttgttcaattttatttattcctgtgtttgcttcatatgatggacttaaacattggatgagttattttttattgattttaaattttagaatttatagagatgtatttgcaataaatttaaaaattaatgataaaaatttatattttgctatagatagtattatatatacttttgctttatgtggatttagtgtgttatttttgacaattttgaaaatgggcattaaagggtattttttatcttatgtagtagctaatatagtttctattatcaatttgatcattgtaggaaaaccattacgagatcttacaaatgggaaaatacataaatcattgttgcatgatttaataatatattcaattccaatgattgctaacggaattgcatggtgggttataactgcttcagacagatttatattacaatattatgaaggtgcttcaagtgttggaatttattcagtcgcttctaaaatcccaacgttgatttcaacatttagtagtgtatttatgcaagcctggattatttctgctgttacagaatatgatgaagatagagaaaaacatttttactcaaatgtttttcacaaatattatgttgcaatgtttgtagcggcaacatgtttgatttctgtagctagaatttttatgagattttatgttagtccagattttcaaattgcatggaagtatactcctctattaattagtggtgcaatatattcaggaatgtttggattttttgtaggtatatatgctgcagcaaaaaatagtaagagtgttacgatgacaacagtagttggagctttaattaatataatattaaattgtgttttcataccagtaatcggaatacaaggtgcagtaatagcaacgtatattgcgtggttagttactacagtaattagaattattgatacaagaaaaattttaaaattctttattgattataaaaaattagcaatattaatgattataaatgtaatacattgtatatgtattataaattttgaaataaagtattcattaattatttctgttattatttttggagtaatatacagtattgagcattctatgattaatgagattctagctcaaggaaagaaaatcttgttaaataagattagattggggaaataatatgggaaaaataaaaaaaattaaacaaaaatatagaagtatattaagaagtagtagagataaggaaaacagaaatagattaagaaatgaaaatattactataatttctgctaattgtgtaggtggcgttatttatcatgatttaggtttaaaatttaattctccaactgtcaatttgtattttaatgcgtctgattatgttaagtttgtctcaaatttaacatattatttgcaatgtgaacttaaagaaatagatagtgaatttgattatccttgtgcattatgtggggatatagttctacatatggtgcattatcagaattttgaagaaggaaaaaagaaatgggaagaacggataaaaagaatcaattatgaaaatttatattttataatggtggatagagatggatgtgaagaaaaagatattatagaatttgataatctgaaatatgaacataaagcatttttaacgtataaagaacatccagaaataaaatgtgcagtttgtattcctaaatcagcggatggaaatcaaattagggatttatgtcaatttaaatctaaatttactggagaaagatggctggatgaatttgattatgtaacgtttctaaataaaaggtaatagtgaagggaagtaaaataaatgtatgattatttggtagttggtgcaggcctttatggggctattttcgcacatgaagcaaaaaatgcggggaaaaaggtattagtaattgataaacgttcgactgtagcaggaaatatatatacagaagaaatagaaggaatacatgtccacaaatatggtgcacatatatttcatactaacaataaaaaggtttgggaatatattaatcaatttgcagagtttaatagatttactaatagtccggtagcaaattataaaggtgaattatattctttgcccttcaatatgtatacatttaataaaatgtggggagttgttactccagaagaggcagaaaaaaaaattaacgaacaaagaaaagaaattgttggtgagcctaagaatttagaggaacaagcaatatctcttgttggaagggatatatatgagaaattaataaaagggtatacagaaaaacaatggggaagagattgtagagagttaccatcctttattataaaaagattaccagtacgtctgacatttgataataattattttaatgccttatatcaaggaattcctattggtggatatacaaaaatgattaataatttattaaaagatataaaagttgaactaaatgtggattatttagaaaataaacaaaagtataattctatagctaagaaaattatttatacaggtgcaatagatgcatattttgattataaatttggaaatcttgaataccgatcagtgaaatttgaaaatgaactactagatatacctaattttcagggaaatgcagctgtgaattatacagataaagacacaccatggacacgaattattgaacataagtggtttgaatttggaaaagatattgatggaaatgatttaccaaagacagtaattagtaaagaatattcttcagaatggaagttaggtgatgagccatattatcctgtaaatgatgtaaagaataatgaactttatgaaaaatataaaaatttggcagataaacaaaataaggttatttttggtggaagattgggtgagtataaatactatgatatggataagacaatagaagtagtattagatatgtgtcaactagaattgtattaaggagtatatatagtgagagtagatgtaattacattacatgcggtgcaaaactatggttctgtattacaggcgttagcaactcaaaagttattggaaaagcatggatgtgaagttaaaataattaattatataagagaagatgtaagatataaaaatattttacaagcaagaagtaatggaaatataataaagaaaattgtcctatatccaaatgtgaaaaaatggaaaaaagtatttaaaggattttgtaatgaatatttgaatttaactgatagaagttatactacagaaaatgattttaaggattatccattagatgcagatatgttttgtacaggaagtgatcaagtatggaattctaaatggaatcaaggtataatttcaccattatatcttagtttcgttccagaagacaaatttagattttcattagcagcaagttttggacaggataaattgtcgcaagatgaagtaaaagcaactaagaaatatatagaaaaatataattgtatttcagtaagagaaagttcagggaaaaagattatagaacaacaatataaatattcttatgctgagcatattattgatccaactttgatgttagatgatgatgaatggagaaaatttgcaaataacaaaaaaactacagaagattatatattaatttataatttaaatcgtagtaaggaattcgatgagtatgctaaaaagttatccagaaaaacaggattaaaattattaagaatatgtaataggtatgatcagttttatagaccgggtaaaagcattattattccagaaataatagagttcataaaacttatagataatgcgaaatatgtattaacagactcttttcatgccacagctttttctatgaatatgaatacagagcctatttgtatatatccaaatgaatttgggggaagaatagaaagcttcttgaaattaactaattcgttacaacgtcatattaaaaattataatgattttgatgtattagatagaaaagttgattttgaaagtgttaataaaatattagatagtgaaagaaaaaaagtaaatgattttttagttaaagtttttgaaaaatacaacaattggaaataaatataaaggagaaaagtatgtatactgatttaaaatcatatcaaataataatttccttattaaagcaatatgggataacgcattgtgttctttctgctggaagtagaaatgtaccgtttgtacattcaatagaagaggatccggaatttcattgttattcagttgtagatgaaaggagtgctggatattttgcattaggactagcacaggaattaaatgaaccagtggtaatttcatgtacatcttcaacggctacttgtaattattggcctccagtagctgaagctttttatcaaggggtgcctattgttgttttaactagtgatcgtgatcctcaaatgctaggacagtgggaagatcaaatgatagatcaagtaggaatgtatgacagacatgtacggaaatcagtaaatttaccaattataaacaataaagatgatgaggtttattgtgaaagattggtaaatgaagcattactggaactaaatcatcgtggaacaggacctgtgcatataaatgttccatcaaaaacatataataactcatttccagtaaaagaattaccaactgcaaaaaaaataaatagaattgaaagaattaattcaaatgttgaatggaaagaaaagataaataaactgaaaagtgcaaagaaaattttggtaacatgtggacaaaaaagttttgtttcagatgaattgaacatagaattggaaaacttttttaaaaattataattctgtaatttcattagattatatgtccaatctaaatataaaagaaggaattaatacaacagtatgtatggacggacgttatataacgaaaaagaaagtacaagaattgatgccagatatcataatttcttttggtggacaaattttttctagtataaaagaagagtttcaaatgtttaagggagaatttgaacattggcttatacaagaagatggaagagtcgttgatacatataaaagtataacgaacattttcgaatgtgatgcagaatatttttttcaaaaatgtaatatgttggcaaatgaagaaagttgcaatgatagaaaatattatcaagaatggaaagaatatgttgataatattaaaattccagaatttccgtggtcacatgcatatgcaataaaagaagtagttgagaaaataccatctaattcggtactacatttaagtattaatgatagtattagaattacgaatttttttaaattaaatccaaatataaaggtatatgccaatattggtacacatgggattgatggatgtttatcttcatttttaggacaagcagcagcaactgaaaaacctagttatttagtaattggggatttagcattcttttatgatatgaatgcattgagattaagacatataaaaagtaatgtacatatattacttattaataatgaaggtggctcagaattttattttaataagatatggcgaaatgatgcaagtgatttacatactacagcaaggcataagacaaaagcagaacaatgggtaaaagaaaatgattttatctatttaaaggcagtagataaagaaagtttggataaagcattaaatatttttatgaatgacaataatgaaaagcctgtatttttagaagtttttacagaaatgagaaacgattcacaggtgttatatgacttttttgatttaagtcgtcctaaagatccaaaatcagaaatgattcgaaaaagtaaagattttttgaaggcaactgtaggacaagagaaagttaataaaataaaatcacttgtaaaaaaataagttttaggagtatagttataaatgtcaggtatttttgacaaattaaagagaaaaattaaaacaattacatttaagaaaattcctgtagaaattccaacattatatggagaagtgttaaaaggaaaagttgcggttgtaacaggaggaacgacagggattggatttgaaatagcaaaggcatttattcataatggagcatcagtaattattactgggagagataatgatagaattgcgaacgcagtagttaaattaaaaaatgaaataagtgataatgaaaatatatttgtgtgtggggaagtgttggataatactatgacaacacaaatagaagagagatggaaacagattttgagccatattgaaaacaaacatatagacatattggttaataatgcaggagtaataagtaagacacattttggaaaaacggacgaaaaagattataatctggttatggaaacaaatttaaagggtacatattttctgtcagaaatagtatcaaattatatgatagagaatggaataaaaggtaatattcttaatatatcttcatcgtcagcattaaggccagctgtttcagcatatagtatggctaaatgggcaattcatggattaacattgggaatggcaaaaaagttaagtccatatggaatagtggtaaattctattgcaccagggccaacagcaactagaatgttgcaatcagacaatataataaatatcaatagaatgtcgtcgccatcagaaagatatgcaacagcatctgaaattgcaaatttagcagtgataatggttagtgatatgtctaaaatggttaatggagatacgatgtatgcaacaggaggttgtggattattgacgtttgatgattacgattaataatgtaatataataatatgaaattaaaattaaaaaataactgtaaaaatataataaatataatatgtttagtgtgttacgttgttctattattatatactacattaattgggcgtgagcatatgaatccatttcatgcagtttttgaagggtggcttccatttcgtagatatgatggtacatggaatttagatactatatataatatttttttattaacacctattacttttttgataagcaaagtttttattataaaaacaaagaaagatatatttttgaaaatagtagaattagcttttgtaatatctttatttatagaaataaatcagttattgtttcaagttggtacatttcaaatttcggatttaatttataatactttatcaggtttaataggatatatattatttaaaattatgtataaacctgaatgaaacttaagttcctggcaccttaagaaatcagtctacagagtgaatagttatattgaataaaaatacgaaaaaatttgaaaaatagattcactttttataaaaaaaggacttttatattgtaaaggggagaaaatacgaatgaatacaacattaattatcatggcagctggaattggctctagatttggagaaggaatcaaacagttagctcagatgggaccaaatggagagatcatcatggattattctattcatgatgcaaaagaagcaggatttaataaagtagtctttattatccgcaaagacattttcaaggagttcgaggagatcatcggaaacaggatcaaagaacagatcaatgttgaatatgtatttcaggagcttgatgatctgccagaaggttttgaagtaccagaagaaagaacaaaaccatggggaacaggacaggcagtgttatgctgcaaagatgtagtgaaagaaccatttgtgattattaatgcagatgattattatggaaaagaagcatttgtgaaactacataatttcttagtatccggagaagaccttggaagagaatttaccatgggaatgggcggattcattttaaagaacacattaagcgacaatggaacagtgaccagaggagtcagtgttgtcgatgagaatggtttattaagccaggtacatgagacaacaggaatcgaaatgggagaagacggacagatcaaatgtgacagtgaagaagtacaggaatggatcagtccagaagataaagtatccatgaacatgtgggcaggatatccagaatttttagatttcttagcagaggatttcaaagatttccttgcgaatgtggaagaaggagatttaaagagtgaatatctgttaccgaatatcgtggacaaacttttgaaagaagaaagagcaaacgtgaaggtgttggagacacaggatcgttggtttggagttacatacaaggaagataaagagactgtgcaggaagcttttagagagttgattgctgatggggtttatgcggagatgctttgggagtagatgaataggtggtagccaataggatgtggtttttgatggaatcatgttttattggctatttgtattttatggaataaattacctgtagaggagtaggatacaattatgatattataacaaaagagaaataatatgtagagaggagattatgaatagtgggagccagtaatcaagaagaaatatatgcagagcagtggaatttaagtgcaaaatatttttatgaaaaaaatagatatcattggatggctaataagttagaagggtatgatacagtcttagaaataggatgtggcacaggatatagtacattagcattagtggaattaggtcatacggttattgctatagataaaaatccagattgtataaaaaaagctaaagaactcgtggaaaaaaatgggaaaagtgatagagtaatatttatagagggggatattactgatgagaagtttagacaaactttaaatgaaaattgtgaatttgacattgttgtttgttggaatgtaggcacagcttggacagaaggtatgttagaaaaatatttaccatatttattggaatatggattaaatattttacaaattcagaataatcaagaaagttcgtatgcagaattaataatatggataacttgcaatatagcagcaaaaaataatgttccagttcaaattattgaaagatgtgctgaagttatagattctgaaaatggttcatattatgaaattttgggtaaggaatttggatattcaaaaattagctatgataatcttaaatgtgatagcatatctagtgaaggacgaatgctcataactaatggtgttgtaaatgatacagcaaaagttgatttagtgttggtatccatattgatgaaggaaaaggattagattagaatagaagattatgtgtatgttagaaaatttaagcattcctgtaattcataaataatgtcaatagacgaaagaagaatctcacagtataattaagatatcatcttggcggatgaaaaacatcttaattatcggaggtccttataatgaattatacacagaatcaaaagattgaacaagtcacagaatcaactttagtactcggagttgatatcggaagttctgaacactatgtcagagcattcgattaccggggaagagagctgacaagaaaagtattcagattttcaactgatatcaatgggttcaacagcttttatgactgggttacacgtaaacgcgcaatagcacctaagcaaaatcaaagtggattaatgttagccggaataccggctcactcaacaccggaatgatggctctcgcgaggcagaatctccaaaaaattcaacggatattatccatactagaaaattactttataaaataaatgaagaattgcaaggtgagaagtgttggagtgtagaagataaaaactggtggataatataattttttgtttaatcagtttaggtgaaagaaacttgacagtagaattgtgattcggaggtgtacaatgtattttgctgatatgagagatgctcaattaattcttggatatagtgatgtgttttcagatgaaaaacctgatcttattgaaaggataaaaaagctgaatatgcataagactatatctattataagtgaattaattcagattagagatgcacaatgtgatcctataaatatagctaatagaatagaatttagtctaccattggaaactattttaaagagagatttttgtaatatgaatccaaaatcgccagaagatttaatgaaaaataagaagatggctaaaaatcagcatgttatttcgttgcagatgttattaattcttctgaaaaaagtgattatatatggaaattatgactctttgaaaattaaggattataaaatccaaaatcaagattatcaagaagtaataatattacaactcttaattgcagatgaaatttccgaaaaacataaaagagatattgatacagatcattttttatatgcaacatatcatttaaactacaggaggaatgcggcaaaagaagttcaacgtatgtattatatgatggaacatctaagcagaacttcagaaattttcgatgatgatgttagagcagaatatagagattattatcaagattttacgttaaaatatggtatcactccaacagaatatattgtttttcttttttgggaattacattattataattcatctaaaaatgccttgtcaaaatctaaatgctggagaaatgttgatataatatataaagatataaaagagaaaagaaaaatatctaaagtaatagacattttaaagacagaaccatttaaattaaaagaatgggccaaacaaactgaaatggaagaatgggattttacatcattttttgctttcccttttctttcagatgggggaaaacgaatacatatctataagtgatattactttagtaaatgcattttttgagaagatattttggcttattagagattgctattcagaagatgatagtagagcaatggcgttttttggtcgtttatttgaacgttatattcaagacgcgacagaagatgtttgtaaaaatgattatatatatattgacgaatttgagtttaaggtaagaagagatattagaaaatcatcagatgcctatataagaaaaggaaaagatttgcttgttgtagaagcaaaaggtttttctgttttagttgattgtatggcaaaaaatgaaaaaattgaaaataataataagaaattattcgttaaaccagtattacaagcagatgcatgtttaaatgaaataattgataagaaggaagaatttgatggcattgaagaagctttcattatctccgttacattagataatattaatgctgtaccgaactattataatgctatccaaaaagaaatcagcgaaagtaaaaagtgcgaattggtttgttattattataattttagtattgaagaatatgaaatgctgttatatctaatagaaaatggaacagacattttctttgttttaagagaatattttagtgagggaatgttagcaccttttagtaattacataagagaaaaagattcaactatagatatgactgaatttatgaataaaaattataaagaagttgcagataaaatgaaaagtatgttgtgggagtgataagaaattttttagaaaattaatctaaagtggaatgcttaagttcccagggacattaagaaatcagtctacaaagtgaatagttttattggataaaaaatttgaaaaatagggtaaacggtaaatcagtgttctctacaaaatcctaaaataatctgagataattaactcaagattttaaacactgtcaaaaatgttaagccttaacttttttgacttgtaaaaaagtttgagtcttaacattcttgattcttttaggaggcgatatagtttatgtcaaaaacaactttagtcacacaacaggttcaattgcaggaatggttccagatgatgcaggaatctaaaggacgacctcaacaaatcccgctggatgaatggtgcaaagagaattatgggatttctgcagctggatattattacagagtaagaaaggtaaaagaagcttatctggatcaggtatctgaagaaaaccttcagcaaaatctggcaatcgtacccaaagaactgcttcatgaagatcggattgtaccaaaaaattcatcaaaacttcaagctgcagattctttccttgatatctttcaggacgatctttgtatccgtatctatgaaaatacgaacgaacagcttctttgccgtgtactgaggaatctaaaaaatgctaaatgatgcaaaaaatcttcaggctgtttatattgtgtgtggttatacagatctaagaaaaggaatcgactctctttcaaacatcatttctcaaacctatgggatggatccttttcaacccggaaccctgtttatgttctgtggtcgtaaaactgaccggatcaaggcacttatatgggaaggtgatggatttttactctgttataaacggttagaacaaaaagccagtaaattccaatggcccagaaatcaggaagaagtctgtaagcttacatcccagcagtttcgatggttgatggaaggtctgacaatccagcctaaaaaatgtattcagaaggtagatcatccccgtttggtctgaatctgtggataaagtattcctgtcaaaatggctttatccacggatttaaaaagttgtctcttatctctttacatatgtttatgttctatgatagtgtggtcttatgaaagagatcatatttaacgagggacaattaaacagatttacaaagaaacagatcatcgaactgtttcttgcccagcaggaacagctgcaaaagcagacaacacagttagaagaactgaaccgaaagtttgacctgatctatgaacagctcaccatgtcacgggcagaccgttttgcgcagaaaacagagaaatttgattatgatcgtaatcggtaacactgatttaccgattacggttaaatattgtattggctgttttaacttggtaaaatataggaaaactaatgacctattatattggataaggatttacaatatgttatactgataaaagagatgataagcgaatagattttagcataaataatgagtacggagaataaaaatgaaaaaaaatcttgaagggaaattacaagaaataataagatttgcacgtaagaaaaacaatacaattagttataatatggcagtagatatactaaaagataaagagcaaattaatgataaagatataactttatcattagaagagttgtttaacagaggaattatagtaacacctgaggaagatgaagaatatttggcaaatgagacagatccagatacatttattcctgcagatgttcaaataagtcagaggacaattaatgtttataatttaatggagagactggaaaatgaagaaattgatttagcacctagttttcaaagaaatggaaatttatggtcattagaggagcaaagtcgtttgattgagtcgttaatgctaaaaattcctattcctgcattttattttaatgcagcagatgatgacaaatggattgtaattgacggattgcaaagattatcagcattttataattttcttgttggtgaaaagaatgacggagaggaaaaaaggaagaagcagagatttgtaggaatgcaatatttaaaagattttgaaaattgtgattttgatgagttacctagacaatatatgagaagaattaaagaaacgacagtggttgcatatactgttgaaaaaggaactccggatgagatagtatttaacatatttcaaagaattaatacaggtggaacaattttaaaaccacaggaaatacgccaagcattatatcaaggaaaagcaactatattgattgaaaagctcgcaaaatgtaatgaatttttgcaagcaacacagaatgctattagaagtgatagaatgcaggatagagaatatgtaactcgttttatagcatttacagaattaaattttgagaaagaatataaggggaatatagatgaatatttgataaaagcaatgaaattagtgaatacttatgatgataataaaattaaaaaattagaaaagaattttaaaaaaataatgaattattgtgcaaaaatatttggaaagtatgcttttagaaagtataataaaaatcaacgaagagggcctataaataaagcaatttttgagatgtgggtcgtatgtttttcggaacttactgagaaacaattacaaacattagaaaataataaagatcaatttttaaaatcatttgaaaaaatacaacaagaaagtacatttattacaacggtaaaggcaggagatcaatattctgtagtaagaagaattgatatagcaagagatttagtgaaggagtttatatgattaataaaatagaagttgaaaattttaaatgttttgataaatttaacttgcctatgagaaatattaatatattatctggaataaatggaatgggaaagtctaccatgattcagagtttattattgttgaggcaatctatgaacaataatgatgaaataaagggattaagaattaatggggaatatgtatccttaggaaatggtcaagatattttatatgaaaaagctgaggaagaacaaataagtttaggatatgaagaagatggaacaagttatttttggaagtttggatatagtgcagaatcagattttttaccagtaatagaaaaaaaagaaggtagggtagaatcaacattatttagttctaattttagttatctatcagcgtatagaattgagcctaaagaattatatggtgttaaaaatgaaatagaaatagataaaagagaatttggaaataatggagaatttgcacttcagtatctaggattacatggagatgataaagtagttaatgataatataattatagaaggcaaattagataattcattagctaaccaggtaagagtttggatggataaaatttcaccaggggtttctcctaaagttacagttaatatgtctttaagaaaatcagaagtaagatatgaatttatagaaggtagagaaaaaagtgattcatataagagtgttaatgttggttttggcattacttatgtattgccattagttattgcattaatttctgctaaggaaggagatattattgttatagaaaatccagaggctcatattcatccagcgggtcaaagtatgttaggagagttaattgcacgagcaggaagtggaggagtgcaaattattgtagaaacacatagtgatcatattttaaatgggatacgtttggcagttaagaaaaaaatggtagataaagatgaggtggtgctttcctttttttatcgaaatgaaaaaaagaaattcaaacatgagtgtattcatcctaaaatattagaagatggtaggttggattgttggccagaaggtttttttgatgaatgggacaaagcattatatgatcttatttaaggagcaaatatgtatttaaatgaaaagtcttggcatgaaaagacagaagacttatatcttatagatatgaagattagaaagtttttagatgtttatgctgaaataaagagaaaaaattcgcaagaagaaatttttgttccagaagaagaaaaattgtatatcaattcagaaagttattctttgggacaatggttaaatgcaacggataaagaatatcaaagattgtatttaagtttttggaataagagagttacttataaattggatgatgattatgaagtacgcataaatgatgaaattttaaaaggtgggacagaatcttggattaacgattcttgtatgttaagcatcgaattaaatgaaaaatggaaagaggaaaatatagaggtaactttaatttctgtagttgaaagtaataaaaaagtaaaaattagaaatgtttctgataaagagcatttagagaatgaaaatataaaaaaattatttattgtagataatgaagttaaatcatataatgaactgtgggaaagaaggggagaattatttccgcatttgtctttttgccctagtgtagaaggaaaactaaaaaatttacaagtgtcttatctcaatcaagtaactaaaaaattggtagagttagaagattattgtgtacaatttcctaaattagcatttgatccatcaaaattaacaaagacaacaacagagagtggtgctactttggagaaatttgaaaaagagcacacatttaaagatgaagatggaaaagaatatttagcaagttggcatatgcgttttacaggaattccaggaagaattttttttatacctaattataatgatgataaagataaaattttaatttgctatattggagaaaaattaaggaatgtttcatatacataaaagtttggatgtggaagtagttaaggtttcagggagggggtgcggacaaaacttggacctgaatatataaatcaggaggttttggatgtacactcgaaaagaaaaggaaattgcaattgaacggtatttgaaaaataataaaaatgcaacaaagacagaataaacttaagtgccctgagaccttaagaaaatagtttacaaagtgaattattgaattgaataaaaaatacgaaaaaatttcgaaaattagcttcactttttgtaaaaaagagacttctatattgcgagggagaaaatacgaatgaatacaacactaatcatcatggcagccggaatcggctctagatttggagaaggaatagggattctcactgtaagattgagcatttagtaccattaagtagggataaagaaaaagcacttgattatcacaacttacttggtgtattagaaaaagtgtcgttgtatgattaggctatgtgttaaaaatgcttgcatttttgtaattaatgttttatagtagaagtgtagtagatacaacaaagaaatagtacattgtaccattaataattgtaattaagggtggtagcttgattacattaaaagcagtagcaaacaaaagggcatccgagtgggtgcctttttgtttgctaaggtcccagggacattaagaaatctattaaaaatattccaaacaaaatacgcatttaacatatagaacaggagaagacacaagaatgaagactatcataggaaaaatcacaatagacattctaacatcgatctatcaaccgttttggtttgcaattttgttatcaataatgacaatgtttttttatttgtatgtaaaatgtccagaaggagcaggcaagggatggaaagcagctatccgaacatggattgaccattttaaaagagatagagaatttcgtaaaaaatatatattgtttttctatattaccatggtattatttaagactttgatcaaccgagatatgtggatgaatccattatgtgatgtgtggggagtatggggaatatacagatataatacagtgacaggccagcgcattttaacatcagagtgtatagaaaattttttcttgcttatgccgtatatagtattaatgttttggaattttgaagaaaaaatatttggtaagaaagtgtatatagggaaaatcatattaaaaagtattcaaatagcgtttctgtcatctctgacaattgagctgttgcagttgtttttaagattaggaacatttcaaatatcagatttattttttaatacaattggaggattagtaggaggaattatttattttctagtgaatgccgcagcagaacggattagacgaatcagaaattaaatacgaccaaacacaaacagccccattcagaaattggtactacaaattgcacaaaaacaataacaaagacatatttattactgaaaattttgctaacaccagagggaaaatgcaaatgaaatgttgtaatttcctagaaaataatgctacatattgattctccgaaattaatttgataaaatataaagcataaatacaggatacataatacaacataatataaagaggagaataacaatgcatttattaggaacgattgcaatgatcttagtgttaagcttaatgatcgcagggcttttaaaattaaattacaaagatttatgggtatcagaagataagacatctagagagccagaggcaagaagattaagaagttgttaagtataagatcaataagataaaagagcaggtacgaaacagagtacctgctctttttggccttacaataagaaagaactgctgattccgccatctacaacaaggtcgattccactaatgaatcgtgcggcatcagagcaaaggaaagcagctgccattccaaggtctttttcttttgcgaaaccacgaagaggtgtgcgattttggatttcttctaatcgttctggtgtttttaagtttgtttttgcgagcatatctgtgtatacgaatccaggatttaagctgttgacacggatgccatatggaccaagatcgcgggaaaggcttcttgtaagaccttttacgccgcttttacataaagtataggcctgaatatcatgcattccgaggattgaagcaagggaagagataaagagaatgcagccgaattttcgtttcttcatattcgcagcaacagcctgtgagaataaaaatggtgctttagcctgagtggcgatgatggtatctaattcttcttcggtaaagtcaaaataatcttttttgttattgattccagcattgttaaccaaaatgtcgataggtgtagtttcttcgattttggaaatgagttcgtcatagtgtgcggtatctgtgacgtcaaatacgtaataagagcaacgttccccgagttttttggcggcttcttttaatttttcttctcgacgtccaagaataataacgttagcatccgcatccagaagttcacttgcaatggcgaacccgatcccggtagctcctccagtgacgatggcagttttcccttttaaggagatttcttttttcataatgctttcctttcgtgaaaatgttaaaaaacaacaaaaaatatttaaaataaagaaaaaatctttataacaaagattataatacaaataacaaaaatgtccatatgaaaatacaataaaataagaaagtatttaaggaaaggatagccagaagatattgacattatagagaataatatttataatgaaaagtatatgtgaggacaaatatatggaatgttttacacaggatataacaagtatacaggtaacaaaacaggtcagatgactgaaggggagatttatggatactacattaataattatggcagccggaatcggatcaagatacggtgcaggaatcaaacagcttgcgaagatgggaccgaatggagagatcattatggattattcaattcgtgatgcgaaagaagctggatttaataaggttgtatttattatccgtaaggacatctttgaagaatttgaagagataatcggcagccgaattaaagatcagattgatgtagaatatgtatttcaggaattagatgaccttccagaaggatttgaagtaccagaaggacgtacaaagccgtggggaacaggacaggctgttctttgctgcaaggatatcgtcaaggaaccatttgtgatcatcaacgcagatgattactatggaaaggaagcttttgtgaagcttcatgatttcttagtatctggagaagatcttggaagagaattcacaatgggaatggctggatttatcctgaagaatacattaagtgacaatggaactgtcacacgaggagttagtgttgtagatgagaatggattattaagccaggttcatgagacaacaggaattatgatgggggaagatggtaagatcaagtgtgatcttccagatgttcaggaatggatcagtccagaggataaggtttctatgaatatgtgggccgcatatccagaatttttagagttccttgcagaagacttcaagactttcttaagtgaagtagaagaaggagatctgaagaaagaatatttattaccaaacatcgtagacaagttattgaaagaaggacgtgcaaacgtcaaagtattagagacacaggatcgatggttcggtgtaacttatcaggaagataaggaagctgtacagaaagcatttgccggattgatcaaagaaggtgtctacccagcgaatttatggggctaagatatatggcataatttaggggcagtcagtgttgaactggctgcctgttttattttagaggaagttttggtgaggtccgctttggaatagaataaggaggatcaaaatgaaatatagcaaaacaattgcgggaattacgatagagatttgtgaaaaagcaataggagaagatcttgttttaactctaagcggtggtgagaaaccgcatattggctgtgttgttcaggcagttccacgcccttcgttgagtggtgacggaacgatcagtgtcacttcatctgtgatcaacctgacaggtcacaaagacgaatttctatgccgcagactggctgagaatcgatgcagggaaacaggaaaagtagtggtatgcacaggcggggtgcacatggatcatataacgggagaacagatcgaagaattattaaagaatatcaatcgtatgatgacagaataagatcatagaagatgatcagaaagcaggtgattttttgaaatttattcatattgcggatgttcattggggagccagaccagagagagagcagacatttggaaggatcagagaacaagaaatcaaagagacatttcaaagagtcattgatcatgcgaataagcaacagctagatctgttattgatcgcaggggatctgtttgatcagccgccaacgcagcaggagctgagagaagtggattatctgttgtccagattgaatcatacaagaacggttttgatcgcagggaatcacgatcatctggaaccgcatgatgcattttctcagtataaatggaattcggaagtttatcttctggatggaaaacaaagagattatatttcttttgaagatcttgaaacgaccatttatggctttagttattggaagaatcagatcacgaaaccattgtatgatcgcatgaaaccagatgagaacgaaggcagtgatttttcaatcctgctggcacatggaggggatgaaagtcatatcccgattcagagagaagcgttaaaatggtctggattcgactatatcgctcttggacatatccataaaccagagatcattttcgaagatctgatggcatatgcaggatcgctggaaccattggatcacacagagacgggatatcatgggctgatcgaaggggagatcagcgaagaaaagaaacagataaccttcgttccctttgcaaagagaatgtatacacaagtggaagtcatgatatccgatgagatgtcagcgttagagatcgtagatcgggtagaaacggaactttcatatcgtggaagagaaaatatatacgagatcatactgacaggaagtattgatccacagatccatctggacttttatgagatcacgagccagtatatggtcacagatatcatttatgaaacgagggatcaatgggaatatgaacagttatcagaggaagatgattttatcatccagaaggtcgcagatattttaaaagatgaaccagaggctttgcgttatgcgatggaagctttaacatatgccagggagaagtaaaagatgaagattgaggagatcaatattgatggatttggaaaatttcataaatatcattgccagacatctgggaagttagaagttttctatggcaagaatgaatctggcaagacaacacttcgtaagtttatgatcgcaatgctgtttgggttggagaaatcaagaggacttgctgcaagatatgatgatttcactagatatcagccagtaaatggcggaatttatggtggctccatgatctttgaaaaggacgggatcagatataagatcatgcgaaacttcggtcaagggcagacagagtatcgcatatttgatgcggatacgatggaggaacttaaggggaaggaatacttattcgaatctgataaacaggcatttgagaatacggtttcgatgacacaggcagagattcgtacaggtagagagatgaaggaagttttgcaaaattccatggcgaatctgcgaagcagcaaggatgccgcgatcgaccttcgaaaagcgatcgatcatttgaaagccagacgaagacaaatgcgaaaagattctgtgtttgcacagattgacaatttgcgaagacagcaggggtcatggcagtatgatgcacaagcgttgaatgaatatgaacaggaagagagagagattcggaaacgtttaagacaaaagagaaagttgacgctgcttcagaagattttgctgtggtttcgaaagttatttggtggggaagatgaagaacgaattcgcaaaatagaactaagacatcgcttagagatcatagagatcgagaaagcacagcttatgcagcaaaaggaagaggcagataagaaaaagcaggaatacgagattttgctggggcagaaaaggaagaaagaacttgagattcacgagatagaacttgcaatgaaagcgatcgaggaagctgcaagccaggtacaaaagacttttggacaggaactaaatgagaagatctcagagattttttgtgatatgacgaatggaaaatatacgcaggcagtcatggatgagaatctttcgatgatggtttatgatggatttgatcatatcgatatgaagtatttaagcaatgccacggtagaacaattatactttgcactgcgccttgcatcggccgatcttttatatgaaaatgatgcatttccgctgtttttagacgatgtgttcggtaattatgatgacgaaagactggcacagacgatgcagtatttaagtcaccatacagatcgtcagatctttttatttacgggcaggaaagaaatacttcgtttattggatgagaaagaaattttatatcatcttatttctttatagctttttctgtgctaagataatgagagataaagtaacaaaggagatcaaaatatatggcaaagaagatgaccatggcagacatcgcgaatttatcaggagttggaaaaagcacggtatctcgctattttaacgggggatatgtaaaggatgagacgagagcgaagattcagaaggtcattgaagaatacaactatacaccgaatgcatttgcaagattgaatgcgaaacaaagcaacgtgatcggtgtagttgtgccgacattaaattctaagatcacaagtcgtgtgatcacaagtatcgatcggtatttaagagaaaaggggtatacaacccttattcagaactcagaccacgatattgatcaggaattacagaatatccagcgcctgatccagttaaatgtggatgggatcttgatcagttccatagcgatcacaaaggaccacaaagagctgttaaagaaagcggggattccagtggttgttttaacacaggattatgaagatggaatttccattatttatgatgattatcatgcagggaaaacgatcggagagtatatcgggaagaaaggacatcaaaaggttggatatattggtgtctatgagacagaccaggcagttggaatcgagcgtagaaatggtgtgttagatggattgaaagaatatgggatcacaccagtgacagggaagagtgattatagttttattggtggacagatggttacaagagaattacttgagatggaatcagatttagatgcgatcatctgtgcaacagaccggcttgcgtttggtgcatataagattttacacgaacataagaagaggattccagaagaagtgtctgtggcagcgtttggaggatatgatgaaagtacactcctgacgccagagcttacaacgctaaagtttgattcctatggaatgggataccttggagcggaaacgattcttaagatgattacaggagaaccagtatccaagaaacagattgtgggatatgaatttattgaaggtggaagtgtcaggtaataaattcttcatacgtgcttataatatcgccctccttccgtattactcggaacggagggctttgccgtttacctgttgctttgttaagtcgtctcacataaaacacaaataaaagtaataaaataaaaaaatgtggtatcgattccataaatactattgacaaatagaagagaaagttataagatacagatatggaaccgataccataataagtttcacaataaaaaaggagagaagatatggattacgcaaaaatcgccagccaggtcatcgagcatgttggtggcaaacaaaacattaagtcagttcagcattgtgcaacaagacttcgtttacagttaaaagacaacgatcttcgcaatgaagatgcagtcagcgacattgaaggagttaagggagtgttcttaacacagtcacagttccagatcattttcggatcaggacttgtaaacttagtgtgcgacgaagtacagaagcagttaggaatctcagtcgatacaccagcagatgttgagaaagaagagaagaaaggaaatgttcttcagagattagtaaagttattaagtgatattttcgtaccgatcattccagccatcgtagcaggtggtctgttaatgggagtgaacaatatcctgacagcagcgatgtttagtggcaagtccgtcattgatctgtacccacagtttaagggtctggcaacagcgatcaacatgtttgcaagtgctccatttgcatttttgccagtattgatcggatttagcgcaacgaagaagtttggcgggaatccatatcttggagcagccatgggtatgatcatggttcatccagatctgttaagtgcatacagcatcggtatcgccaaagcaccagtatgggatatctttggatttaagatccaggcgatcggatatcagggaactgtacttccagtattagcagttgcatttattttagcaacgatcgagaagaagttacataaagtaacaccaacatggttagataacctgacaacaccattgatctctatcatggtaacatcatttttaacattcatctgtgtaggaccagtgttaagagaagcaggtaacttattagcagatggaatcacatgggtatataacacacttggatttgtcggtggcggattattcggacttgcatatgcaccgatctgtctaacaggaatgcatcacagctttatcgcaatcgagacacagctgatcgcagccaaagcaacaacaggtggaagttttatcttcacaacagcaagtatgaacaacgtagcacagggagcagccgtattagcagttttattcttaacaaagaatgagaagatgaaatcaatctgttctgcatcaggtgtttctgcattacttggaatcacagaaccagcaatgttcggtgtaacactgaaattaaaatatccattctacgctgccatcatcggttcagccgtaggtaatgcatattgtgcagcaacaggagttttggcacaggcattaggagcagcaggacttccgggattcctgtccatgcttccaaaagattacttaaacttcgtgatcggactgctcttatccatgggagtatctgcagttttaactgcagtcttctggaagaagtttaacgtcgaaggagaagatcacaaagcagagactccggttaaagaagaagtaaaagaaatcgaagtacaggaaccagcagatacaacagaagaaataaatgaattatatgcaccaatgaaaggtgaagttttagatgtagcaaagtctgcagacccagcatttgcaagtaaggcaatgggagaaggtgtagcgatcaacccaagcgaaggcatcgtatatgcaccagccgatggaacgatcagtctgatcttccctacaaaacatgcaatggggatcacattaaactcaggagtagaacttctgatccatgcaggaatcgatacagttaagatgaatggcgaaggttttgagactttcgtagaaacaggagccaaagtaaagaaaggtgataaattattatcttttgacatggatcttgtgaaagaaaaaggatacaagacacagacgatgttcttagttgcagatgcgaaaggaaaagaagtcgaagtggttgaagcagcggatgcagataataatacgaagatcatgaatttaaaataatcattattcgaagaaggaaaggaaaccagggcagatgtttgaaaaatacaagaaagtctataaggcagattatgaaaaatggtataaagaaaatgaagcttacagacaacgtgtggcagcagatcaagatcgattaaaattccatttaatgccaaagacaggatggttaaatgatccaaatggtttatgccagtttaatgggacataccatatttactaccagtacactccatttgaaccaactggtgagttaaagacatggggacattatacgacaaaagattttattcattatgaagattttggaccagtcgtattcccagatgaagacattgatgcccatggtgtctattccggctctgcatttattgaagatgatacgatccactatttctacacaggaaatttaaaatattttgacagagatgattatgactatatcaacagtggacgtggaagtaatacgatcacatttacaagtaaagacggctatgagtttaccaaaaaggaattattaatgacaaccgacgattatccggctgacatgagcaaccatgtgcgtgatccaaaaatctttaagaaaaatgagaaatattacatggttcttggagcaagggatgttgaaggtgtgggtatgatccttctatatgaatctacagatcttaagaactggacatacaagaatcgtatcacaactccacagaagtttggttatatgtgggaatgtccggatctgtttgaaatggacggacagttatacatcatctgctgcccacagggagtagaaacacaaggcattgattacgaaaatgttcatcaggtcacagcaatgaaattagactatgattttgataccgatgaatatgagatcacagatatcaaactttttgaccgcggatttgatttctatgcaccacaaagttttgaggatgaaagtggaagaaggattctgatcggatggatgggaatcccagacgcagactatacgaatccaaccgaagaagcaggatggcagcatgcactgacgattccaagagaattatccgtaagagacggaaaactgattcaggaaccaatcgaagaattaaaacaacttcgaagcgaggacaaagcagtttgtacattttgttatggacaaacgattatcatgcaaaatgcaatctatgaagctgttgtagattttaaacgatgcagagaaatggtaatgacactgcgcgaaggaatcacgctttcctataaagacaatatcctgaccttaaatcttggagtctatggaagtggaagatcaacaagaaaagtcagattagaaaaattagagcatcttcagatttttgcggatacttcatccttagaaatctttgtgaatcatggagaagaagtttttacaacaagaatctacaatcattatggaagactactgattaatggagaatgttctggtataatgactgtatatccattaaaatcatttgaaatcgaaggaggaagacatgaagaataaattatgtgggattggagaagcactgatcgattttattcctgaggttaagggacagcgattaaaagatgtaccttcatttaaaagagtcgcaggaggagcacctgccaatgtagtcggggcagtcacgaagcttggtattccatccaaatttttaacaaagcttggagatgatccatttggagattatatcgtggaagtattagatgaagcaggaattgacacttctaatattgcaagagacaaagaaggggaaacagccttagcatttgtatcccttgcctctgacggaaatcgtgattttaaattttatagaaaaaacagtgcagatttacgctacagtgtagaagatatcccgacagatatcttaaacgattgtggaatgattcatttttgcagtgtagaccttgtggaatctccaatgaaggaagctcacaagaaactgatcgatatggcgatcgcgcagaatgtgaaagtatcttttgatccaaacttaagattttcattatgggacgatcttgatcaattaaaagagacagtcaatgatttcttaaaatatgcagatatcatcaagatttctgacgaagaactggaatttatcacaggacatacagatatcaaagatgctctggacggtttatttgctgatcgtgcaaaatacgttatctacacaaaaggagctgacggagcagaagtgtatacgagaaatggaatggtagaagcttctggatataaaatcgatgtccgagatacgacaggtgctggagattcgtttatcggagcattcctatactgtctgttaaatgatgaagtagaagatttggagtccgtaagtgatgacacattaagaaactaccttgattttgccaatgcttatgcagcgaacacaacaacaaaagaaggtgcattagcagccatggcagatcgagctgagatggatgaatggatgaagacattaaagaaataaatcaaataaatccttatagaccatagaagaaagaagagttgaatgtagtatttggctcttcttttttgtagtagaagaaatctccgagactcctaaatcagaaaaggagatcgtagaacgtaattaaaacacagtatacatgaaaaaatatttgttaaatccttgacaacatatttttttagtcatataattagcgtacaaagtattggtacacgaaaaataaaacatacgaagaatataacaggcaaattattttgaccagacaggaggataaaaagaatggttgaatttaaattaacgaaagaacaactgcttgcaaaggaattgttcagaagtttcgctgagaatgagatcaaaccaatttccagagatatggatgaagcagagaaatttgatatggatctgttagataagatgaagaaatacggtctgatgggaattccatattctaaagaatacggtggagagggagcagatgtattaacatatgctttagcaatggaagaggtatccaaagttgatgccagtgcaggaatcacaatttccgtacatacttctctttgctgttcttgtattaacgactatgcatcagaagaacagaaacagaaattcttacgtccattagttgacggaagtaagattggatgttttggactgacagaaccaggagctggaacagatgccagcggagttaaaacaactgcaaaattagacggtgatcattatgtattaaatggtcagaaagtatttacaacaaactctggatttgcagatacattcattatttttgcttacacagataagagtgcaggaacaagaggtatgtctgcatttatcgtagatagagacagcgaaggattaacagtcagcaaagatattcctcgtatgggaatcagagcagcatccaacgcagaagtagcattagttgatgtgaaagttccaaaagaaaacctgatcggaagagaaggaatgggatataagatcgctatgggagctttagcaggaggacgtatcggaatcggtgctcagtctgttggtattgcacagggtgcattaaatgaagcgatcaaatacgtaaaagaaagaaaacagtttggaaaaccaatcgcaaaattccagaatacacagttcttgatcgcagcattacagacaaagattgatgcagcaagattaatggtatggagagcagcgaaagcaaaagatgatcatgaaaattttgcaccacttgcagcacagtgtaaattatttgcttctgatgtagctgttgaagttacaagaggagcagttcagatgcttggtggatatggatactcaagagaatatccagtagagagaatgtatcgtgatgcaaagatcacagagatttatgaaggtacatccgaagctatgaagatgatcgttggcggtggattattaagataagaaagaaggagacaagagaatgaagattgttgtttgtgcaaaacaagtaccagatacaacggaagtaaaattagatccaaagacaaatacactgatccgtgatggtgttccaagtattattaacccagatgataaagcaggaattgaagcagcacttcagttaaaagaaaaatgcccaggaagtacagtaactgttgtttctatgggaccacctcaggcagatgttgcattaagagaagcattagcaatgggatgcgatgatgcattattgatctcagatcgtgcatttggaggagcagatacatgggctacttcttctacaattgcagcagcattaaagaaattagactatgatgtgatcatcacaggtcgtcaggcaatcgatggagatacagcgcaggttggaccgcagatcgcagaacaccttggaatccctcaggtaagttatgtagagaagatggatgtagaaggggaagatactttagttgtccagagacagtttgaagatcgtcaccagatcatcgaggtgaagacaccttgtcttttaacagcattagctgaacttgctgatccaagatatatgtctgttcacggtgtatttgatgcatatcgtgaaaaagaagttaaagtatggggattagaagatatcaaagatacagtcaatgaaggaaatatcggattaaaaggttctcctaccagagttaagaaatcctttacaaaacaggcaaaaggtgcaggaacgatcttaaatgatctctccgatgacgaagcagttgccgcaatcgtagaaaaattacaggaaaaacacatcatttaaggtaaggaggacaatcaaaatgtgtaaagatgtttatgtatttgctgagcagagagatggaaatcttcagaaagtcggtatcgaactgatcggagaagcaagaaagcttgcagatgatcttggacagaatgtagttgcagttttacttggaaatcagattaaagacaaagcaagtgaactgatcgctcatggagcagataaagttgtagtagtagatgatgaaatgctggcagaatatgtgacagaaccatatgcaaaagcaatgatggagatcattcagtcccataatccagagattgttctctatggagcaacatcgatcggacgagatcttgcaccaagagtttctgcaagaatccacacaggattaacagcagactgtacaaaacttgatattgatgaagaaacaaaattattaatgatgacacgaccagcatttggtggaaatatcatggctacgatcgtctgtgaagatttcagaccacagatggcaacggtaagacctggtgttatgaaagcattagaagctgatgaaagcagacaaggtgaggttgaagttgttgaagtaaactttacagatgcagatatgaatgttaagatccgtgaagttgtaaaaacaacacacaaatctgtagatatcacagaagctaagatcctggtagcaggaggacgtggtgtaggaaatgcagaaggatttaaagatcttgaagcattagcggatacattagatggtgaagtggcagcatcaagagcagctgtagattcaggatggatcagcaatgaccgtcaggttggacagacaggtaagacggttcgtccagagttatacttagcatgtggaatttctggagcgatccagcacgcagcaggtatggagaattcagaattcatcgtagcgatcaaccgagatgaagacgcagcgatctttgatatcgcagatcttggtgtcgtgggtgatattaagaagatccttccaaaattaaatgatgcgatcaaagcagtcaaagaaaaataaagtataaatgaaaactcctaaaaacataaaaactcaaaaaattaaaaactccaaaaaacagaaagatggacggcgtgaaaaccgtctatttttctgcttttcggaaagtaaaaatacttgacgaagaattgttgaaatgttacaatacaaaatataattagcgtacgaaatatttgcaaaataaacaaaaggagaaataagatgagatttgttgtgattttaaaacaaattccagatgattcgatcaaaaaagaatatcaggatgtggatcagttaaatgacagtgataagaacgtaataaaagaagcactggatttaagagaccgctatggtggaactgtagatgtgatcggatttggaccattatctgcagaagatgttatgaaagagacgcttacttatggaattgatgatgccttcctgatcagtgattcccaattcgcagatatggatgtatcacaggtagccaagatcgtcgcagcggtgatcaaaaagcttggtccatatgatctggtcttatgcggacggcaggcaattgatggagatagtgcccatatggcttctatgacctcttgtgcgttggagatcccattgatcgcgtattctgacgagatcacagagatgaaagatgaaagtgttttcgcaacatgtatgggtgatcagatggcatataaggtagaagcaaaaactccagcaatgatactttctatcagagagaagaacaagaaccgttttccatccgtaccagatatcatgaaaacatatgatggaacatataagacaaagatattgacgaatgaagacctgaatttttctgtgaccaagagaaaagtaacgcaacttagaaaatatgaagtcaaaagcagcaaacagcaaaaacttgttatgatcggtggaaaagacgaagaagaaaaagcggcacagattcttcagttattaaagcaaaagagcgtgatctaggaggtgtatggagatgaatttagggaaaaaagaaggaatcgttgttgttggagagattcaaaagagagagatcatgccgctgacgttggaattgatcggggcagcaggaaaactttcgaaggaaagagatctttcattgtcagttattctatcagaatgtgggatcaaagaagaggcaaagaagctttacaattacggagttgatgaaatcctctgtatcgaagatgaaaaattaatagaaggacatatgcagctgcatcatgatgctgtcatagaagttttaaaaggaaaggatccgaaagtgatactgatcggaggaacagcatcaggaagagttcttgcaggaaagacagcttatgcatttgatacagaattagtctgtgatgcatcgaaacttacatacgatgagaaacaggaacaacttatcatcacaagaccggcattcgatggaaaaaatatggtagactttgtgatcaatccatccttgacatcggtgatcacgatccgtacaggagtgatgggaaaagcagaatacaaggaagacaaacaaggtgagatgttatatgtatatccagaatgtctgaaggaagaacgacaagatctgatctatcacggagtggcaggaaaaagtggaaaagaagttcatctggatacagcaaggatcatagtttccggtggccgtgggatgaaaggagaagaaggatttgcgcttcttgagagacttgcagagaagatcggaggggaagttgcatgtacaagaccatgtgtagatgccggatggatgcttccaacacagcaggtaggacagtcaggaatctccgtaaaaccgaaactgtatcttgcatttgggattgccggggcaattcagcatatgacaggaattgatgcagattgcatcatttcagtcaataataatccgagggctgcgatctttgcatacagtgattatggtgtggtttcggatgcaaagaaattactggagagtatgttaaaacagatggaagaaggaaaagaattcttataaaaatggataaaaaagtatgctgtgtatctggttttgatatacagcatactttttttaatataaaggtaagtcttagaaaatactggttaacgcaatgaatacaagacagtcgatcagaggaatgaagatctgtgtgactgcgatatcccagtatgcttctttatgtgttaatttacagatacctaataaagtgatctgagctccctgatgaggaagggtatctaaagttccagcggcgatcgtggaaattctatggatatcaggaaggctggcaccaagttttaaataagtatcttttaatgctttaaaagcgactcccataccaccagaagcagatccgcaggcaccagcacaaacagcaacggttaccataacgaagattaaaggaggcatggatagatgttttaatcctgcaacaagatcagtaaatccctgtgtttttgcaacaacaccaccaaatcctacaacgatagctgtgttaaggatagaaactccagaatcagcggcacctttattaaagatattgatccattccgtcatgccgtcgattcgtttaaacattaagatcgtggcaagtgcaacacctgcaaatacagaagtttcaacagggaaaggatgccatggattattaaataatactaagatcacgatgatcggaaggactgcgatggcaacatgtggaagatccgggttttcttcttcagaaggcagttcatcctcagataattgatattttaaagtactgtcaaaaaatccatacccttttttagtaaaagaacgggcacgaaattctaaccagaagaaaatcatcaaaaacattgcgatcgcagttaacaaagatggaacaaacgcagccgtagatggtgttccaagactatccatagcgataacattctgtacagaaggagaaccaggtccactcatagaccaagtccagcatcctgcagagatggcagcagggatcaggcggcgggtaagatttgcttctttgaacagattaagtgcgatagggtaaataacaaagaatacaacgaatccgctgacaccaccaaaggttaataaaccagtgatgatcataatgatcggtgctacaaattttccgtgacataaactggcgatcgcacgtgcgatcgattctgctgcaccagtatactggtaaacagctccgaacaaagctcctacaaagaataccaaaaagtaacttgtgacatattctgctgcggcaggcatgaataagttttttaaactgtcaagaatcggcatgccggagcagatgatcacaaaggaagttacaagaggagcgaggatcaaagcactcatctgtttaaaagctaataaaccaaataagatgatagcaatgaccaatactaaaatatgtatattcatataaatctccttttgggggacaataaactagttattcaagacccatgatctcatctttaaaaatccgttcatccatgagtttcggtttgccatccatttttggtacgaatcccatatggtcaagaatctgagtctggatgtcaattccaggtgcaacttcagtcagataaacgccatcttctcgaagttcaaagacagcacgttctgtgatatacataactggctggccaactttattggcatatttaccagagaaagtgatctgttctacggtatcaatgaatttatcagattttccttcctggtcaatgatcagttttccgtcttttgtagaacattttaaaccaccggcagtaaatgttccgcagtagtatacacgtttagcgttctgagtaatattaacgaaaccaccgcatcctgcaatacgtggtccaaacttgctgacattgatatttccatctttatctgcctgagcaagacctaagaatgcatcatcgactccaccaccatcatagaagtcaaactgtgcaggctggtctaagatcgcctgagcatttacagccccgccaaattgaggtccaccttgaggtacaccaccgacaggaccagcttctactgttaaagtaaagtgatctccgataccttcttcatttgcaaccatagagatatattcaggaataccaattccaaggtttacaacggtgtcaggacgtaattccatcgcagctcgacgtccaatgatcttcttaggggaaagagaaggagcttcaaggcttccaagaggaacacgaaattctccagtcatagaaccatcatattcacatccgacacactgtgtatggttttctttgttctctgtgacaacaaccgcatctacgtagattccagggacctttacaagttttggatcaacgtctgtgacaactttctctacctgtacgataactttaccaccacagttttttgcagcctgtgcgatcgcagtagcttcagcagtacaacattcatgttccattgtaatgtttccatattcatccgcataagtagcacggatcagtgcgacatcgacatggatcgccttatataagaggcgttcttctccgcagatattaacaacttctacaagatcttcggttgtgatatcatttaattttccaccttctacacgtggatctgcaaatgtataaagaccaacatgtgttaaagtaccaagtttcttggcagcaatatcacgataaagctgtgataaagtaccctgaggaaggttataggctttgatcttattttgcatgattagctcacccagtttaggagccatattatagtgaccagcaataaccgttgatgtcataccctcatgtgcaaaatgatcagcaccacttccatcacgatttccctgtccagcagcataaaagtaagtcagattttttggggaaccggtttctaaaaatcgtttttctaacgcagaagttaattcttctggcagatcacatgctacaaaaccgttggtagagacggtcataccgtcttctaccaagtttgcagcctcagcagcagttaaaatttttactttagccatggctttttcctcccaaaatcactctagaaatctgtaagatttgctttacgtttctctaagaaagctgtcataccttcttttttgtcatcagttgagaatgcaagaccaaataagtctgcttctaatgttaatccgcttgaaaggtctgtttctgtaccagtgttgattgcttcttttgcaagagaaatagcatagcttcctttgctcatgatcttctcagccattgccttacaggtatcaagtaattcagcctgaggaactactttgttagcaagtccgattctgtaagcttcattagcatcgatcatatcacatgtaaagatcaattcttttgcacgtcctttaccaaccagacgagcaagacgctgtgttccaccgaaaccaggaaggataccaagtcctgtttcaggctgtccgaattttgcgttatcagatgcgatacggatatcacaagccatagagatctcacacccaccacctaatgcgaaaccattgacagcagcgatcgtaacctgaggcattgtttcaagttttaagaaagcttcttttgcaagcattcccatttttctaccttctgcaggtgttgcatttaccatttcagagatatcagctccagcaacgaaagcttttgctccagaacctgttaagatcacaactttgatatcttttctctcagaaatttcagagaagcaagcatcaagttctgctaaagtttcactgtttagggcgtttaaagattttggacggttaatagtaacaacggcgatttcgttttccacttccattaataaattgttcataacatatcctcctacatagattaaaaataaataataaaataataaacaatgtatgcaatttttggcaacacgaatatttagcatacaaataacttgtgcctacattatgcgcccttgttattaatttgtcaataaaaattagtgaaaatatataaaaaaataaaagaataaaaaaatgtattgacaaaatgaacaaataaaaatataattagcacacaaagtatttgcacgcaagtaataagacaaacaaacaattacaaaggcgttcagataaagtgataataaaagagaataagcctaagtaagaagaaaggaagatgtacgatgaattttgaattaacacaacagcaggcagccattcaggaaacagcaagaaaatttgcacaggaagaattacttccaggagtattagaaagagatgcaaacagtgaattcccagtcgaacagtttcataagatgggagaacttggattagtcggtcttccatatcccaaagaagttggaggacagggtgcagattatctttcctatgtattagcagttgaagaaatttccaaagttgatgcatctatgggaattggatattctgttgtaacttctctttatggtggaagtatcatgaactctgcagcaccagtagagaagaagagagaattcttagaggaagtattatcaggaaaatgcttcggttcctttggactgacagaacctaacgcagggtctgatgctggtggatgtgtcacagtagcagaaaaagatggtgatgattacatcttaaacggattaaaatgctttaatacaaatggaccattagcagattacacagcggtttatgcactgacagaaccagaaaagaaagccaaaggattatcttgctttgtagttaagaaaggaacacctggattcagtgttggaaagattgaagataagatgggaatccgttctgcacaggtatcagagatgatccttgagaatgtaagagtaccaaaagaaaatatgattgtagaatctggacagggattcaaacttgcaatgaaaacattggatggtggacgtatcggtgttgctgcccagggacttggaatcgcagaaggtgcatttgagattgccaaagaatatctaaagacaagagaacagtttggaaaaccattatatagaaatcagtatcttgcattcaagatggcagaacttgagatggaaatcgaagcagcgaaattaatgttatataaagcagcaacagataaacaggaaggaagaccatactcactgccagcagcgaaagcaaaatatttatgtacagaagcagcaatgcatgttacaacagaagctgtacagatgttaggtggaaacggatatatgaaagaatatcatgtagaacgtatgatgagagatgcgaagatcacacagatttacgaaggaacaaatgaaatccagaaactgatcgtaagcggagcaatcttccgatagaaaagaatataaaattaaaaatttcttctccttaagtaaaaagttatcggataggtttgaactatctgataacttttttctatttcttcatagaaaattttaatgaaatctactatgaaacaaaaaaggagagaaaactaaattacttgacacataaaaaaaagcaagctacactaatattagtgtgcgaaatatttaaaggagaaattatatggaactaacacaatgtattaattatttattaacaacagcacagcataaagtttttcaggagatgagttccagacttgaaaagtttgatgtaacaccagttcagtatggtgtcatgtattgtttatggatcgaaggaaaaacaaaaccaaaagagatcgcagcagaattaaagctagagaactctacgatctccggagttttagaacgtatggagaagaaggaactgatcgaacgtcaggtaagcaaagaagaccgtagatttatagaagttgtattaacagagaaaggaaaagcattacagaatccgatccttgcgacggtagaagaagtgaataaagatgtattgtctgagatgtcgcaggaagaacaaagtgaactgaagaaagccttgaggattctgggtggactggaggacgaataaagagaactctggtcatgacagacagggataagtatgagagtaacaattcgacaaattgcagaagaatcaggagtttccagaggaacggtagaccgtgtattgaataacaggggaaaagttcgtccagaagtagaagaacgagtccgtaaagtagcagaggagcttggatataagccaaatcttttaggtcgtgcattgatcaagatgaaagagaatatcaagatcggtgtgatccttcaggatacaggaacgccttatttaaaaacattatcggatgggatcaagaaggcaaaaggcgaagtagaagattttggtggaactgtcattgtgaaagcggtagattatggtaatgtagaacagaccttagcggcaatgaataagctgaaagaagcagggatcaaagggcttgtgctgatgccgatcaatgataagagagttcttcagaagatcgatcagtttacagaagaatatgggatatccgttgtcacagtgaatgcagatgtggaagatacaaagagaatttgttttgttggacagaactctgtacaaagcggcagggcagcagcaggattaatgcatgatattctaagagaagaagaaggaacgatcgcagtgatctctggaattgagacgaatacttcattaagtgacagaatctatggattttgtgacgagatgaagaaaatttcaccaaagactgagatattagatacaaaatactgctttgaggatgatctgatcgcagcacatctgacagagagtattttgaaccgttacgaagatttatctgcgatttatattacctgtcatggagaaaaaggggtatgtgatacccttaggaaacataagaagatgaagaaagtgaccatcattgcatgtgacctgtcacggcagaattacagatatctaaagaatggagacatcaagtatctgatcgggcaggatggacgttatcaaggatatgaagctgtcatgaccttatatcggttattatttaatgatgagccgcccaaaaaagaacataagtatacagatattattgtaaaaacaaagtacaatatttaatgatgtaagtgagaataagaacaagatcagggaaatatccttggtcttgttcttattttcgtacatttgcacaaaatttaggaagaatttttgtgcagtttaccaattgtgtgctcgaacacaaagtgctataattcaaaacataaaagatgtgctcgaacacaaaacacaaaaaacaaatcaaaagcgtattagaaaaggagaaacaattatggtaaacgtaggaattattggagcaggaagaatcggacaggtacacatgaacagcattttaacaagagtaccaaatgcaaagatcaaagcagttgcagatccattcttaagtgaagaagcagacaagaaagcaaaagcagctggagcagagtatacaacaaaagattacaaagatatcttagcagacaaagatattgatgcagtgatcatttgttcatcaacagatactcattccccaatctcaattgaagcgatcaaagcaggaaaacatgtattttgtgaaaaaccgatcgatcatgatgtagacaagatcaaagaagttatcaaaacattagaaggaacaggacttaaatatcaggtaggatttaacagaagatttgaccacaactttgaagcagcacagagagctgttgtcaatggaaagatcggagcacctcatatcatcaagatcacatcaagagatcctgagccaccaagtgctgaatatgtaaaagtatctggaggaatgttccttgatatgacaattcatgattttgatatggtacgattccttgcaggatgtgatgcagaagaagtttatgtacaggcagcaaaccttgtagatcctgagattggaaaagcaggtgatgttgacacagcgatcatcacattgaagatggaaaatggagcacttgcagtaatcgataactctcgtcaggcagtttatggatatgatcagagagcagaagtattcggatctaaaggaatggtagcgatcaagaatgattctgattctacagcagtgatcagcaacgaagatggtgtaacaggagaaaaaccacagttcttcttccttgaaagatacatggatgcatatggaaaagaaatggttcagttcattgatgcaattgaaaatgacacagaaacaccattaggagtagaagatggattaaaaccagtacttatgggacttgcagcaaagaaatcagtagaagaaggccgtccagtaaaaatttcagaaattgaattctaatttgaaggagagtgtatatggaaaaacatacaaatgaggttgaagacaatcagatgagagcacttagctggaagaccagagtgtcttacggcttaggtgatacagcgtgtaacgttgtatacggaatgatcggaagcctgttaacgatcttttatactgattatgttggaatcagtgcagcagcgattggtgtgatcatgctgatatccagaatttttgatggatgttctgatgttatcatgggattcgttgtcaataaaacacacagcaaatatggtcaatccagaccatggatcttatggatggcgattccatatgcagtatcggcagtattattattcacagtaccacatactgcaactaacatacagttaatatatattttcgtaacttataattttacagcaacggtctgctatacagcgttgaatcttccatacggaagtttatctgcgatgatgacaagatcttccagagaaagagatatgttaagtatcgttcgtatggcactttctccgatcggaagaatcatggcagttacatttacaacaccactggttaaattatttggggatgaccaggcagcgtgggtaaagacaatggcaatctgggcagtcttagcactcctaatgctgatcacgtgttttaaaaactgtgaagaaaaagttaagatcaaagtagtgaaaaaagaaaagatccctgtaggaaagacattttcagcattactgaaaaaccagtatttctgggcagtactgatcttatggatgatgcagaacgtcatcacatcgatcacaggaacgatccttccatactactgtaagtatattcttggaaatgatacatggatgtacagtgtattatacatggtagaaacagttacattgatcgcagctactttatgcagtccgttattattaaaacgacttggaaagagaaatatgtccttgatcgggtgtatcggatgtctgatcggacaattcgtattcatggtcaagccagagagtttttattggttacttggatgttgtatcatcagaggaatctgttttgcaccattaaactctgtaatcttcggaatgttaggagatgttgtagaatttggtcagtggaaaacacatttacgtcaggagagtttcatcttcgcgatcggatctgttggtacaaagcttggaaacggaatcacagctgcagttttaacacagttattagcatttagcggatatgtcagcaaagctggtgttacaacacagccacagtcagttgttaatatgatcatgaatatctataaagtaggaccattgatcgtatgggtaacagtcgttattatcttacttctgtacagattggataaaaaatatccaatgatcatgaaagaattagaagagagagaagcaagaggcgaattataaaaattttgcacagtgtgtgctcgaacacaagaaaggaataagagatgtttgataagaataaagtaaaattaggaattgcaccaatcgcatggacaaatgatgatcttccagatcttggagctgaaaatacatttgaacagtgtgtcagtgaaatggcacttgcaggatttacagggtcagaagtaggaaataaatatccaaaagatccagcagaattaaagaaagcattagatcttcgtggaatcgaaatttgtaatcagtggttttcatctttcctgatcacaaaaccattagaggaagtagaaaaagaattccgtgcacagttagagttcttaaaagcaatgggagcaaaagtgatcggagcttctgaacaaagttacagtgtacagggacaggaagatacaccagtttttggacataaatatgtgatggacgatgaagaatgggatacattctgcaacggaatgaattatcttggaaagattgcaaaagaggaatacggaatcgcattaacattccatcatcatatgggaacagtcgtacaagacccagatgaagtagaacgcatgatggcaaatacagatccagaatacgtaagtttattattcgatacaggacattttacttactgtggagcagatccattagaaatggtgaaaaaatatgtaaaccgtattaaacatgtgcatttaaaagatatccgtccagaagttgtaaaagaagtgaaagacaacgatttaagcttccttgaaggagtaagaagaggtgcatttacagtacctggagatggatgtattgattttgatccgatctttaaagtattagaggagaatggatatgaaggatatatgcttgtagaagcagaacaagatccagcaaaagcaaatccattagaatatgcgatcaaagcacgtaaatttatcagagaaaaaactggattataaaccaggagaaagaggcatattatggggaatacattgatcacgatcagccgacagcacggaagcggtggaacaaaagtagcacagattttggcagagaaattaggaatatggtactacaacagagagattctttatattgccgcagataagatcggatatgattctctcgatgaaaagagcatggatgagattaattataaaaaggcttccaaatatatggaaggacttagtatcatgacaggttcaagaaatcatattccagtttataatcagatgttcaaagaacagtctaagatcataaagaaattagcaggatacggatctggcgtcttcttaggaagatgcgcagattacgtattaaaagatgaaccaggagtgtgctccgtgtatctttatgcagaggaatcttaccgtataaagcatctgtcagaaaaagaaggaagagcggtaacagcagaagaaatccgaaaagaagataagatgcgttcatcatactacagttattatactggaagaaactggtatgatatggaaaattatgatcttgcgatcaatctagcgaccattgaagcagaagaagctgcacaattgatccttgattatatggaaaaaagaaaataaactccaaattgattgacaacattacaagaaagtgctaaattattatcaaaagataaccaataaatactcaatagataatcaaaaaaggagaaatgagatgaaaaaaaggaatgggatgatggcagcaggagctttcgcgatcttgtttaccggatttccacatatatggtcaatttatcagccatatgtactctctgagacaggctggagcgaaagtatggtatcaatttgtttttatcttccaactttgttttttgtagttggtaatatatttggtggaagaatctatgacaaaggatatggaagaataaccctcggaatcggagggagcgtatttgcaggtgggatcatattatcagcattgactttaggaattcatccaatgatcacttatatgatgctaggtgtcatgcagggaatcggacaaggaatgatctatgcagtcgtacttgcaacagcacagaagtggtttcctcataagaccggatttgcttcaggagttgtgatcacggcgaatggattatgtggattcatcttatctccgattagtaagctcttattagaaagaggtggagtaagaatggcattgatatctgttgggtttctggttttcttatcagcagtttgtgctgtctgctttgtcagacagccagaggcagaaaatatagaaacaaaagaaaatcagatatatgcaggacaacaatatacatcagttcagatgatcagaacaaagaagttttattatcttgtagccacgatgatgtgtggtctgatgccgtattatctggtgtcaccgatttcacagacgattcagattgaaagaggaatcttacaggcagttgctgtaggttccgtgatggcaggatctatactgaatgcagggatcagactgatccttccaacacttgcagacagagcaggaaggattacttgtattcaaggagttttgtttgttgcaatgattgctatgctctttttaatcagtggaaataacaggctcatcacaatggcaattatcctagcctatggatgttttggcggtattatgggaagttttccatcattatcaagtgaggtttttgggcttcgatatgcaggacagaattatggaatcatcatgtcagggatcatcatcgtaacgatcacctcgccggtcatatcgaatatgatactgatccatgaattgtcagaggtagtaagatttatgacaggattttgttttgcagtgatcgcattaggatttagtatgttattaaaaaaagagataaatcaatcaggaaaggaagtaaaaaattatggcacttgttaaaatgaaagatctgcttcttagagcacagaaagaaaacaaaggatgtggagcattcagtgtaggaaatatggagatggtaaaaggtgcgatcaaggcagcagaagaacttgatacaccgatcatccttcagatcgcagaagtgagattagaccattcaccactgcatctgatgggacctatgatgttagaagcagcaagaaatgcaaaagtagatgttgcggtacatctggatcatggattaaaatttgagacgatcaaaaaagcattagaatatggatttacatctgttatgctcgatgcatccagagattcatttgaagaaaatattgaaaaaacaaagaaagtggtagaacttgcagcaaaatacggtgccactgtcgaggcagaattaggacttgttggtggaagtgaagatggaaaaagcgaccatggaatccgttgtacaaacccagaagatgcgaagatcttttgtgaaaaaacaggaattgatgcactggcagtagcgatcggaaatgcacatggagattatccagttgcaccacagttagaatttggtgtgttagaagaaatccatgataaaacaggaatccctcttgtgcttcatggaggaagcgggatcacagatgctgatttccagaaagcgatctcacttggaatccgcaaagtcaatattgcaacagcaagctttaagagcttgacaaaagaagtagaaaactatctggcaacagaaggtgcacataattactttgatatgaatgaggcaatggtacttggaacatataagaatgtaaaacatcatattgaagtatttaactgtaaataaatataatatgaaacaggtattgcatgaggaaaagtgtaatacctgttttttatttgcaaaaaataaaaaacgagttataatatatgcgtgcacgataacgcaaagaaaggagaacaagaaatggcagtaacaatgcaacagattgcggatctggcaggtgtatcaagaggaacggtagacagggcattgaatgaccgtggacgtattcgaccggaagtggcagagaagatcaagatgattgcaaaggaacttggatatcagccgaatattgcggcaaaggcactatcatcaggcaatcagatcctgcggatcggagttattttgcaatacgcagataccccgacgatccagacagtattagaaggagctaaggatgcaaaacaagaagtagaacgttttggcggacgtgtgatgatcgaccagatcaatggtggagatgtaagacaggtgttggatatcatgagaggctataaagaggcaggtatgaaaggaattgtactgatgccgtcgaatgatgagatgttaaaaaatacgatcgaccgctacgtagatgatggcattgagatcataacgattaattcagaccttgaagatacaaagagacgatgttttgtaggacaggataattatgcaggtggccgtgttgcaggaggcttgatgggagaaatcattcctgatggtggaaaggtcatgatcatatcaggatctgcagacaatacagcaactgtaaagcgaaccaaaggatttatggcggaattaagctatcattatccatcaatcacgatcatggagccaagatttgcatatgatgataactgggtagcaggaaaattattagaagaacagttagagatcactccggatctgaagggaatctatatgccggcacagggagaaagtggggtatgtaagattcttaaaaaatatgaattagagaagaagatcaaggtgatcgtacatgattatgagggagagaacaagaagaatctgaaagaaggtgtgatcaattttgtattaagacaggatgcttatgcacaaggatacgagtcggtaatggagatttttcatagtctttgtgggaatccaggacataaagaagaattttgttatgaagatatcgtgatcaaaacacgatgtaatctgtaaagaggagagaaatattcaggatacagaaaggatatttctctcctctttttgtactcaaaataggattttcgcaaaggtaaaaggatagactttgataaaattgcacaaaaattaaaacaaaacattgtgcatctttgatattgcgtgcacgtgaacgcaatgctaagataaatacatcaaaaggaaaacaaaacaaaaaacataaacacaaaacggaggtagaaaaaatgttaaatgtaggtgtaatcggatgcggtggaatgggaaaagatcatatcaaacgtctcacagaaaaaattcagggagcacaggttgtagcagtatctgatgtatttgaagagggagcaaaagaagctgcgaaaatcgcaggaggagcaaaggtttatacagatggaaaagatctgatcaatgatccagatgtagatgcagtatttatcgtatcaccaggatttgctcatacagaatctttactacaggcgatcgaagcaggaaagagagtcttttgtgaaaagccattagctacaacagctgatgattgcaaaaagatcgtggaagcagaagttgcttcaggaaaacatctgatccagttaggatttatgagaagatatgacaaaggttatgtacaggtaaaagaagcattgaaatcaggagaatatggagaaccattgatcttacattgcacacatagaaatcctgaagtaggaacaaattacaatacaccaatggcagttcacgatacagcgatccatgaaatcgatacattacattggttagtcgatgatgaatatgaaagtgcacaggtgatcatgccaaaagttacaaaatattctcattcagaactgaaagatcctcagatcatgctgcttcgcacaaagagaggaatctgcatcgatgtagaagtatttgtaaattgtaagtttggatatgatatcaactgtgaagttgtatgtgaagacggagcgatcaaaatggcgcagccatcttatccatcaatcagaaaagatgctgcagtatcaacaaagatcgatacagattgctttgtaagatttaaagatgcttatgatacagaagtacaaaactgggtagattgtgcaaaagacggagtgatcaatggaccaactgcatgggatggatatcttgcagcagtaacagcagatgctttggtaaaagcacaggaaacaggacagattgaaccaattcatacagatgaaaaaccagaattttataaataattgaaagtcagtgggaggtaaaaaagatgaaaattggatttaatgaagcaacagcattagagtgtaaagggcagtctttgattgcagatttagaagcatgtgaaaaatatggatttgattatattgaaatccgttttgattgcatcaaggattatttaaaagaacatacattggaagaattagcagattggtttaagaatcatcgtttaaaaccatgggcttataatacattgatcttctttaatcagagagatgaagcaggagtgaaagagattgatgaagagacagaatttatcatggaagtaagtaaagctattggtatgaagatgctgattacagttccatcctttgatgttaaagataaatcagtcagtgagatcaaagaagaagcagtcgaaagattacgctatttatctgataaggttggagaagatattaaaatttcactggaattttgtggggctccaaattgctctattaatcagtttggaacagcatatgatgtagtgaaagcagttgatcgaagcaatgttggaattacggttgatacattccatttccatgaaatgtgttcaaaattagaagatctgaaagcagcagatggtaataagatttttgcatatcacttaaatgattgtgaagacctgccacttggatcttgcggagatgataaacgtttatggccaggagaaggcgttgttgatcacgaaggaattgcatcagcattaaaagaaattggatttgatggagtttgcacgattgaagaattcagacctgaatattacgaaatgtcacatgatgaaaatgtgaaaaaggcagcagaggtgacaagagaattcgtaaataaatatttctaaaaagggggaacactgatgacagcatatgaagaaacactccatgtaaacccggagaaaaatttcgaagaattaaataatgagtttgccaaagtaaaattatcagagaaattggcatattgtgtaggagatccggcattgacagtcatttatacactggcaaatacactgcttgtatatttttacacaaatgtcattggattatctgccgggatcattggtatgatcatgctgttatccagaggatttgacggtgtttctgatattatcatgggtacgatcattgatcgtacccactcaaaatatggaaaagcaagggtatggatcttaagacttgtagtgccgtatgcgatcgcagcagtattattaatgactgtgccaaacacaacgacatcattgcaggcaatctatgtgtttattacttataatctgctaaacactgtgatgtatacaggaatcagtcagccatttcatacactaggatcattaatgagccgcgataagcatgaaagagaaacaatcagtaatatccgaatggctttatctatcacggcaagtatggtcgttacagcatggacattgccgatcattaactggacagcagataaaattaacaatacacagcttgcatggatcattgtaaccggtgtgtttgcagcaatttcagtatttattttgctcaatacattccgttgttgtaaagaacgtgtagctgttgcaggaaaaatagaagaaaaaataccagttttcacagcactgaaattaatggtacagaatcgatatttcctgatatctcttggacttatgttattttatacagtctaccagatcattcttggaattgatcttacttactattgtcaatacgttatgaacgatgtaaatcttgtaatgccgctttctatggcagagaaaattccaatgatctttattatcttattacttcctaaattgattcctaaatatggtaaaagaaatctgatcgtatcaggatgtattcttggaatcgtaggacaagtgatgtttttatttaacgatacaagcgttccattagcaatcgtatcttctgttattcgtggaatcggtatgtctccattctacggggtacagtattcacttccaagtgatgcgatcgaatatggacagtggaagaccggaaaacgaattgaagggcttatgttctcatccatgagttttggacagaaattcggtgcaggaattacaaatgcagttctaggtgcagttttatctatggttggatataacggaatggctaagacagcggcacaacaggcaccagcagctatttcagtgatcaagtttacatatctgtatgtaccgatcatcgtatgggttgtgatgatgctgatcactatgtgttacaaactagataaaacatataaacagatgatggcagaattgtctgtaagagaattatcaggaaaattataaaacagatgaaggattcatattttgaaaggcaaaaggtgaaggatatgttagataagaaaaaagtaaaattaggaattgctccaattggatggacaaacgatgatatgccagatcttggaaaagaaaatacctttcagcagtgtgtgagtgaaatggcattggctggatttacaggatctgaagtagggggaaaatatcctacagatgtagaaacactaaaaaaggcattagatttaagaggaatacagatctgtaactgttggttttctagtttcttgatttccagaccatatgaagaaaccgaaaaagaatttatcaaacagacagatttcttaaaggcaatgggagcaaaagtcattggagtatctgagcaaagttatagcattcagggcaaagaccagccgatctttgaaggaaaatatgtaatgaatgatgaggaatggaaactgctcacagatgggttaaataaacttggacagattgcaaaagacaaaggaatgatgttaacattccatcatcatatgggaacagtgatacagacagaagaagaaatcgatcgttttatgaacgaagttgataaagacctggtttatctgttatttgatagtggacattgctcatttgctgggattgatccagtcaaagttttaagcaaatatattgaccgtacaagacatatccatttaaaagatttaagatctgatgttgtagcacagtcaaagaaagaaggctggagtttcttaaaaggtgttagagaaggaacatttacagttccaggagatggagatgtagattttgcaccaatttttgatatcatcgaaaaaagtggatatgaaggatatgttgtggtagaagcagaacaagatccagcaaaagccaatccattagaatatgcaatgaaagcaagaaaatatattgcagagaaaacaggattataaaaatggaggtgtgacagatgaaaatagcatttgatgttgatgttcttgcaaaacagatggatattaaccgcatggtacatcaggtagcagactggggttataaatatatcgaacagtctccacacccacggatcaatccattttacaagcatccattattttcaaaagaatgtgaggctgaatatagaaaagcacttagagagactggagtagagatttcttcttttatcgttgtatatcgctggtcaggaccaaccgaagagcagagaaagatggcggttgaaaactggaagagaatgatagaaatcgctgttgatatgggagtaccagtcatcaatacagaattttctggagatccaaaccagcaggaaatctgcaacggaatgtggtatcgttccatggaagaattattaccgatcatcgaaagagaaggactgcgagtggaagtacagtctcatccatatgacttttgtgaattaaataatgaagcctgtgatcttgtaaaatcattccgatctccaaatcttggatatgtctattcttccccacatggattcttctatgatgaaggaaaaggtgacgtaagaagcatgctcaaatatgcaggagatgagttaactcatgtgttatttgcagatacatttaaccagacgctagactgtcgttatattgccaatccaccatggttaaaccagagaggaaaatcagatgttacgatccatcagcatttagcaatgggagaaggagatgtagattttgatggaatctttgagacattaagagagatggattttgcaaaccgccagttaaaagcggatgcaccaaaagttggtggagataatatcgcatgtgtatccatgtttggattcccagagaaaatggacaagcaagcaccagaagcaagagaacgaatcgaaagagaacttttgtaagaaggagaatggaagatggaaacaatttatcaaaccattgtaaaagactgtggctgtgatgtaggtgcatttgacaagaagaattttttgatcacttttggacataaaacattggtaacattaaaagatttttgttattttattgatgtaacacctttgaaaaagaagatttgggctggagatatactgaaaattgatgatcaggaatatgaaattttaagaattggtgaaattgcatcagataatctggctgcacttggacatattacaatcttttttacggaagaaggggaatgtctccctggaagtattcgtgtaaaaggaaaagaatttccaaagatagaaaaagaaagcaaaattgaaatcctaagaaaatagacaaaaagaagcaggaaattatggttgttcctgcttctttttgcttacggtgtttctatattgatggaatgcatcttggcaaaatcacagaattcttcactaggaagttgatccgtaagaatgtgatcgatatccttaaacggacaaaatgtcatcaatgaaaaatctccaaatttggaatggtctgcaagtgcaaaacggatcgtactgttttctatcacagatttcttgaccagatattcttcagaagatgcattgctaagtccattttgaatggagattccagtacaagacataaaagctttggtgatattgtaagctttgaggtattctgcgatatttccatcaacaaaagataaagtttccctctttaagaatccaggaagagaaattacatttaaattctcataagggatggcttttagagaaacctgcaggctgttggtaaggatcgtgcattctttctcggcaataaagtcaatgatattatgacatgttgtcccactgtcgataaagatcgtatcatgatcacaaacatgagatgcagctaactggctgattagtcgtttctctttcataaaactttgatggcgtttggaaaaaggaagcaaagtctttgatgcaggagtgtctgcgattgttactccaccataaactttcttgatttttccagattgttcaagagttgcgatatctcttcggaccgtgttctttgatacattaaatacttcacataacgtatcaagagagacagattttttttcgcggatatataattcgatttcatcaattcgttttgttctcataataattccttttaaatagttttgttcatatagactctattattataatatactataaatggtaaaaaaagagaaaaagaatgtcagagtatataacattctttttctctttttgcgtatattcaataatagaaaattatcgatcaagtggaacataatgtccaccgttcatagttgcaagagcattattgaaaacctctgcagactctctgcttgtgatatattttacaaatctttctttgagagaaagttttttctcactgtttgaaaactcatgattaaactctgttgtatgtgtcataataaaaactcctttaaaacgaatattgtattcagtattttgtggtttttatcatagcacgatatataggggatttctacagtttttctttacttttttatgtacaaaagctataatggaacaaagaatgtgctatttgtgtgcaaataagaagaaaggtgagaaagcacatggcaggaacgatcaaagaaattgcagagaaggcaggggtatcaagaggaacagttgacagagcgttaaataaccgtggaagagtcaatccagaagtagcagaacgtatttttgagattgcaagagagatgaactatcagccaaagagaaaaaagaaagtatataatcaaggaaagaagatcaggattggtgtcattacccagttagcaaaatcttcttttgtaaagacgattcatgcaggaatcgacaaggctgaacaggagttggaagaattcggtgtagagattatcagaaaacagattgatggagtaagtgaagacgcccaattggaagcgttggaagaactttcgcaagaacagatcgatggattagcaatcatgccagttcagtctgaacgaattcgggaaaagttaaatgatatgacagaacagaatgatcttccgatcataacatttaactcagatatcgttggcacaaacagagtctgctacgtaggacttgataataagagaagtggtatgacagcagctggtcttatggggatgttaacccgtggaactggaaaagtcctagtgatcactggtttctttacaaacagtgtcaataatcttcgtgtggatgggtttattcaggaattaaaaatgtcatatccagagattgaacttctgggagttcagagcagttttgatgagatgagtgaagtggagaagatcgttgagaatacgatagagatcgctccagatcttgctggcatttttgtagtttccggtggtcaggcgggtgtatgcaaagcaatgcaaaatcttaacatggaaacacgcccatatgtgatcgggtatgatgtgacaccgacaaatatcaaggcattgaaagaaggaacctatgattttctgatcgatcaggaaggctttgaacaaggatatcgtccaccacatctgttatataatatgataagaaaaggcgagaagatagagaaagagtatgcttatacggatattagtataaagacgaagtacaatttgtaaaagagaataaaggaaaaagaggttttgaaatctgcaatagatttcaaaacctctttttggtgtgtgaaaaattcaagcagaagcagttgagaacaaatcgaatatggaaagattaaaagtgtgcttttgcgtgctaaatggagtctgaattatttaaaatgcacaaaaacagcaagatgtaattgtgcaaaaagatgaaaagaaagaaaatgataaaaaacacttgcacactaaatgcgtgcgtgataatataagcacataaagaaaacacgcaaaacaaaaataaaaagcacgcaaagcacatagtatgaggtgaaggttatgagatatgtagaatttgatgaaacaagacctatggatttaattttattaggacgtgtcgctattgattttaatccatcagaagatgagccattcggaccacttgagaatgtcagaacttttaagaagtatgttggtggttctccagcaaatatcgcagttggggttacaagacatggattaaaagcaggatttcttgggaaagtatctgatgataagtttggtaaattcgtagttgactttttcaataaagaaggaattgatacaagtcacattacaaaatgtacaaacggtgaaaaactaggacttacatttacagagatgctatcagaaaaagaaagcagcatcctgatgtatcgaaattgcatcgcagacttacagttatctgtcgatgacattgatgaagattacatcaaacagtcaaaagcaatcctgatctcaggaacagcacttgcagaaagcccatcaagagaagcagctttaaaagcagtgatgttagcaaagaaaaatgatacaaagatcatttttgatattgattatagagaatataactggaagagtgaagatgaaatctctatttactattctatggtagcaagagaagcagatatcatcatgggatccagagaagagtttgacttaacagagaaactgatccagccaggaagaacagatgaagaaacagcagctgcatggcatgcatacaatgcgaagatcgttgttatcaaacatggtatgaaaggatctacagcatacacgattgatggacagaacttctcaatcaaaccattcccagtcaatgcaagaaaaggattcggtggaggagatggttatggatcagccttcttatatggaatctatcagggatgggaagttatcgactgtttagagttcggatcagcagaagcatctatgatggtaagaagtaattcttgttccgaagaacttccaaacccacagcaggtaaaagacttcattaaagaaacaaaagaaaaatacggagaaatgatcgcaagagtatagggatcaaaaagtcaggaggatagaaagatggcaaagacagtaagaatgacagttgctcaggcaattgtaaagtttttagataatcagtatgtttcaatggacggagaagaaacaaaatttgtagaaggattcttcacaatcttcggacatggaatcgcagttggacttggagaagcacttgataccaatccaggaaacttaagagttcttcagggaagaaatgaacagggaatgtgtcatgttgcaacagcttatgcaaaacagaatggaagaaagaagatcattccttgtgcatcatctgtaggacctggagctgcgaatatggtaacagcttgtgcgacagctacagtgaataatattccattattagtatttccagcagatacatttgcatcaagacagccagacccagttcttcagcagttagagcagagcaatagtttatcaacaacaacaaatgatgcatttaagccagtgtgcaaatattgggaccgagttacaagaccagaacatatcatgacagcactgatcaatgcaatgagagttttaacagatccagcagaaacaggagcatgctgcatcggtctttgccaggatgttgaaggtgaatcttttgatttccctgaatatttctttgagaaacgagttcacaggatcacaagaccagtggcagtggaagaagagattgaagacattgcaaatgtgatcgcaaatgcgaagaaaccacttgttatcgttggtggaggtgttcgttactctgaagctggggaagaagtagaaaaattttgtgaagaattcaagattccatttggtgagacacagggaggaaaaagtgcatgtagatcaagccatccatactgcatgggaggaatcggtgttacaggtacttatgcatccaatgttcttgcaaaagatgcggatgtagtcattgcaatcggaagcagaatgtcagatttcgcgacaggatccaagagacagtttgcaaatcctgatgtgaagtttgtatctatcaataacagcagatatcatgcatataaattagattctgtgaaagcagttggagatgcaaaagtaacagtgaaagcattagctgaaaaattaagagcaatgaattatgtttcatcttataatggagagattgaagaagccaaggctgtatgggataaagaaatgaaacgtctggctgagtacaaatatgatgaaacatttgaaccaatgatcaaaaatatggatccaagaacaattccagaattcgtggagctgacaaaaggtaagatcacacagacagcagcattagcaacgatcagagatgtgatcgatgaagatgcaacgatcatcacagcaggaggaagcttaccaagttgtatgcagcgtgtatggacaacagataaacgtggtggatatcatgcagagtacggatattcttgtatgggatatgaagttgcagcagcactcggagttaaacttgcagagcctgacaatgaagtctatgcagttgttggagatgcaagtttccagatgttacacagtgagatcatgacaatgatgcaggaaaaacagaaagcaaatatcttagtattcgataactgtggatttggatgcatcaataatctgcagatgaatcatggtattggatcccttgcaacagaattccgttacagagaaggaaataaaccttgcggagatctgatcccagttgattatgcaaaagttgcagaaggatatggattaaaatcttatacatgtaagacgatcgaagaattaagagcagccttagaagatgctaagaaacaaaacgttgcatgcttatttgacttaaaagtaattccaaagacaatgacagatggatatgaatcatggtggaatgttggaattgctacaacttctgaaaaagaaagcgttcgcaaggcatgtgaaggtgttatggaaggaagaaaagaagcaagagcttactaatagaaagaaggaagagacaatgggtaaagtatttggatatcctgaatttgatgaaaatggagaacagatcttaacaacttatgacaatgaatataaggatatgttaatggatgttcgagtatatcgaatgaaggcaggagacgaaaaaagttttcaaaagacaggtgaggaaacagcagtcttattattaagcggttctattgaatttgtatttgatgatgtgacagcgaaagcagatcgaaaggatgttttcacagaaggaccttggtgtgtgcatgcagcaacagaatctaaggtaagtgttaaggcacttgcagatagtgagatccttgttcagtcaacaaagaatgatacaaagtttgacactaaattatataaaccagaagatgctccatggggatattcttctgttggtaaatttggaaatgtggcaaaacgccgtgtaaatacgatctttgatcatgatatcgctccatattctaatatggtacttggagaagtattaaatgacagaggaaactggtcaggatatctgccacacagacacccacagccagaaacttactactttaaatttgaccgtccggaaggatttggagcaagtttcgtaggtgatcaggtatttaaaagtacagatggaagtttttcagcaatcccaggtggagaattacatccacaggctgttgcaccaggattccagatgtatacatgctggatgatccgccatctggatggaaacccttggttacagacagatcgaaatgaagatgagagatatctctggcttcatgatgcacaattttaatcaataaaaacaggaggaaaagaacatggcaagagaatttattgcaccaggaaatatatttacaggtgccggcgcacttgatatggcagaagacaaattaagacagcttggtaaaaaagcactgattgttacagacaatgtaatggtagaacttggaaactgtgcaaaagtagaagcagcattaaaaaacggaaatgtagattatgttgtttatcatgagatcaatggggaaccaactgatgttatgatcaataaaggattagagctttacaaagaaaacggatgcgatttcttagttgcactaggtggaggaagtccgatcgactctatgaaagctatcgcagcactcgttgcaaatggtggaaatatctccgactatatgggaaagatcattggtggggaacttccaacaactgttgcaatcccaacaacagcaggtacgggatcagaagcaacacagtttacgatcattacagatacacaaaaagatgtaaaaatgttattaaaaggtgcagtgttaatgccagattatgcaatcattgatccacagtttacaatgactgcaccaccaaagatcacagcagcaacaggattagatgcactgacacatgcagcagaagcgtatacatccaaacttgcacagccattatctgatacatttgcattatcagcgatcaaaagaatctttaaatacctgccagttgcattccatgatggaaagaatgtagaggcaagagaacagatgtcaatcgcagcgttagaagcaggaatcgcatttaacaatgcatctgttacattagttcatggaatgagccgtccgatcggagcattattccatgtagcgcatggattatccaatgcgatgttattaaaacaatgcttcatctatgctttagatggtgcttacgatagatttgcagatctaggaagagcgattggagctgcaaatgatgcggattctgataaagaagcaagtgaaaaattccttcaggcggttgttgatatctgcgatgaacttgaaacaccaacactggaagaatacggaatcaacaaagaagaattctttaatgtgatcgataaaatggcagcagatgctatggaaagtggaagcccatccaatacaagaaaagcgatcacagcagaagatgtaaaagaaatttataaaaatttatggtagatgttataaaatcgccaaactcctaagaaacatataacataaacaaagataatcataaatgaaaactccaaaaatataaaaaataaaactccaaaaaacatataaaactcaaacacatataattcgaaaaatctaaaaaagaaaaggatcaccatattatgaacggatcaaaatggtggttcttttcttttttttgttggtattgaaaatgatcagccagataatcgtgaattaacattctgaaaaagtggtttttcaaagttataatttgcccgatttacacgaagatggccatatttcttcacgtatttaaactgtagataaatctttttcttagaataaattaatttctttaaagttacagctttcccttttggtacacgaaaagtaacttttttgctgccagcttttttataaaaagttacttttttggcagtgataaacttattttttgcaaaatatcttgaatatttatcttttctgttttgtccaagttcgcttcgtaccgtttttgtagaagatgcagttctaatgaatttttgcttactgtatttaaaaggcagtgtccaattgatccatccggtttccataggttgtacacgatgtttaacggtaatcccttttttattggcagtaacgatttcttcagcgtaagatgagtgatcattaaaagattttacaacacgaaattggttggattttttgttataagtaaagatttcattataagtaacgtagtcattttcaccacggccaataatctggataaatgtatgttgtttgctcatttttgcatattttacagtgaggtcataacagtcgtgatcacggagagatatttctgtggtcctttttccatttagatagatcgtaaaacggttgatgtaccagccttcttgatcgggtgttgtacggatgatcacagaatcagcattttcgtctccagtgatgtcaacattaccagcataagttccagaagtttttgtttgaggtatgtttttaacagaagcttttacaaatgatggtgtcataatgcataatgtaaaagcaaaaagaaaacaacctaaaatcctgtatacatttcttttcataagaaaatccctccttcttaagtatatgaaaactaattgtttctaattacattttaacacatttcattgtggaaaatgcacaaaaatattgtatatataataattaaattaaagaatgtgacgaaattaaaaaaagtgcttatacaagacataaaaagtgtgtataataatgcattgacaagaaataagcaggaaagaacgcagtgaagattgcacacaatagaaagtggagatccgcaacgagtttggttgagggtctccactatttttttgccttatttcttgaagaaaagcaacaatttattacaacaagaagaggagaaaagaaaatgccacagaataaaagagaaagccttatctatacattcatcatgtgtttcatgatggtattttggatgagcatatacaacgtatcattacatatgggaggattatcaatggaatccatcaaagccggatggttagggttcccgatcgcatatatttttgcaatgtgctgcgactggttctttgtatctaagatcgcaaaaggatttgcgtttaagtatcttgtaaaaccagacagctctgttttaagaaaagttatttcagtatcttgctgtatggttgtacctatggtgatcattatgtcactttatggagcagtcgaagttagtatcgagatggggaatttctcaaacttactgataatgtggcttacaaatattccaaagaactttgtaatggcacttccttatcagttgatcattgcaggaccagttgtgcgctttgtgtttagagctgcatttccggaaggaaaagtgcttgcataataaaagaatataacagatatatcaaactgacataaccacatttctttcctttcctatataaatgtgctagaataatcgttagaaaatttttggagggaaagtgatgaaaaacaatgtcaaaaatttaatcgaatttattgatcatagtccaagctgctttcatgtgatcgagaatgcaagaaaacagtttctggaacatggttttatggaattaaaagagaaagaatattgggatctggaggaaggaaagagttactttgttacgagaaacggaagttctatcatagcatttcatttgccaaagaaggattttcaagggtttcacatcgtggcaagccacagtgattctccaacataccgtatcaaagaacagcctgagatgtccgtagagaaacattatacgaaattaaatattgaacgttatggtggaatgatcccagaaacatggtttgatcgtccattatctgttgcgggacgtattataatagaagaaaacggacagatcaaagatcagttggtcaatattgacagagatcttatgatcattccaaatcttgcaattcatatgtcaagatcttcaaatgaatcaaaacagttaaatccacaaaaagatctcttgccattatgtggaggaaatcttacaaaagatggttttgaggaaatgatcgccaaagaatcaggcgttgagaaagaagatatcttagcttatgatctgtttttatataaccgaatgagaggaacaacactaggaatcaacgaagaatttgttgcagcacctaaattagatgaccttgaatgtgcatattcatccatcgaaggaatattaaatgcaaagctttccaaagattatgtcacagtgtgtgcggtctttgataatgaagaagtcggaagtggtacaaaacagggggctggatcaacatttttcccagaggtattaaaaaggatcagttatctttgtgaaaaaaatgaagaagaatattatatggcggtggcagacagctttatgttatctgcagataacgctcatgcagttcatccgaactatcaggataagacagaccctacgaaccgtccgtatatcaatgaaggaattgtattaaaatacaatgcatcacaaaaatatacaaccgatgcgaattcagcggcactcgtaaaatatctgtgtaaaaaagaaaagattaagtgtcaggtattctttaaccgttcggatatgttaggcggttcaacacttggtaatatcctgactggacaggtgtcgatcaaggcagcagatatcggacttccacagctatccatgcattcaacatacgaaactgctggatgcaaagatttagatgatatgatcacactgatgggatctttttatgagcttggaaaggaagtgcagatttaatggaagaaaaacatttgcagatgtcagagagttttttcttaacagcaattcttgcaatcgtaggaggctttcttgattcctacagttatttaatgcgtggacatgtatttgcaaatgcacagacaggaaatatcgtattgtttggtgtgaatcttcaaaagcgggattttacacaggcattttactattttgttccaattcttgcatttgctgtgggcgtaattcttgttgagatcataaagcatttttataaggaagaacataagattcattggagacagagaattgtggcacttgagtttgtgctgataacggttgttggatttattccactgggacaatatgatgttgtggcgaatgtactgatttcttttgtatgttctatgcaggtggagacatttcgaagggttcatgggcatccatttgccagtacgatgtgtactggtaatttaagaagtggaacagaagcactgtgccagtactttaaaacaggagataagacattaaaacaaaaaagtttacgatattatggaattattacttttttcattattggagcagtgatcggaggatttttaaccggtcgtgcaggaggaagttctatctttatctgtagtattttgctagcgatcgcaacgatcttgatggcaaaagagttcagaatctgataaaaagactgattttacaaacatttaacaatgtttgcgaaatcagtctttttttcttttgtgttactcttcagggaaaacttcatttacaagttgacagtattcctcatactcatgaaattctgaaagatcagcaaaaccttcgatcattccacgataataccaactctgcatcttcttatccttcatattgaatctctcccataactcttcgccaaggatgttataatcccgataaagtgcacggatgttagcaagcttgtcaccaagggcgatgatcttagcgttgcgggatgcacggttctttaagaaatcgatcgtatggccttttctctcaacccatgtcttactcttatcttcactttcctgatagacataagaagcaacgatatcaccgaattcacgacggatgtcatctatcgagattccgtcacaatcttcaacaacatcatgaaggacagcggcacaaagcatatcctgatcgagagtcatagcggcaacgatggcagcaacttccatagggtggatgataaaaggaagattggtgccttttcttgtctgaccgttgtgggcatttgttgcgtagataacggctttttcaaacattggaaaactcctttattaaaataagttagtgtaaaataattgttaagataatcataaagcatttttttttggtattcaagtaggaaatccaagaaaatagataggaaaatactttgtcactttaaagcgtgtcagtgttgactttttaaatacaggaagttaaaataaaaactaagtgtgatcaaagaatgagaagattttgtgatcaccgcaagaaaaaaggagagtaaaacaatgacagacagcaattttacgatcggatttatcggtttaggattgatcggtggatccattgcgaagggaataagaagagtttttccaaattatacactcattggaatggatgaaaacccggatacgatcaaaagtgcattggaggatggaatcattgattcaattgctacagactgcaaaacagattttgcggaatgcaactatgtatttttgtgtgcaccggttcaatataatgtaatgtatctaaaagatctgaaaggatcgattaatgaaaattgtattttaacagatgtaggaagtgtaaaggaagagattcacttaaagattgaagaattaggaatggaagaatactttatcggaggacatccaatggtaggatcagagaaggcaggtttttctttcagttctgacagattagttgagaatgcttactattttatcacgccaacgaagaaagtcagcgaacaaagagtgaaagattttacaaactttattgaagaattaggagcattaacgatcattctggattataagcagcatgatgcctatactgcagcgatcagtcatgtaccacatatcatggcagcagaactggtacatatcgtaagtaatatggatacagatgatggaatcttaaaacagttagctgcaggtggttttaaagatatcacaagaatcgcatcttcatctccagtcgtatgggaacagatttctttatcaaataagaagaatatcaaagaattactgcaaaaagcacagaatcatctaggctatgtgatcgcagcacttgatatggaagacagagaatatttgaataattattttaaacaggcaggagaatatagagattctgtgccagacagtgcggttggtctgatccagaaatcttacgagatctttattgatattccagatgaaccaggaacgatcgcaacaacgacaaccttgcttgctttgaatcatgtaagtatcaagaatattggaatcattcacaaccgtgaattcgaagaaggtgttttaaagatcatgttatatgatgatgaatcagcaaagaaggcgacaaaaatcttaagagataaaaactacacagtatacgagaggaaataaaaacatgaaattaacaaaaagtgcgggacttagaggagaattatcaattccaggagacaaatcgatcagccatagagcagttatgtttggatctttagcaaaaggaacaacacatatcagcaatttcttatcaggagcagactgcctgtcaacgatcgattgttttcgtaagatgggtgttttgatcgaacaggatggaacaaacgttacagtccatggaaatggccttcatggcttaaaggcaccaagtgagacattagatgtaggaaatagcggaacaacaacaagattgatctcaggaatcctggcaggtcaggattttgaaactgtattatctggagatgcatccttaaataaacgtccaatgggaaggatcatcaaaccattagaacagatgggtgcaaagattacaagtgtgaatgggaatggatgtgcaccattgaagattgaaggaacaaaattaaatgcaacacattatgattctccagttgcatctgcacaggtaaaatcctgtgtgttattagcaggattatatgcagatggcaagacaagtgtgacagaaccagcattatcaagaaatcatacagaattaatgcttcgttcttttggagtgaaagtagaatcacatgatacaacagcgacgatcacacctccagaagagatgatcgcaacagatatcgtggttccaggagatatttcttcagcaactttctttatcgtagcaggactgatcacaccaaattcatgtatccgtttaaaaaatgttggaatcaatccaacaagagatggaatcctgcgtgtatgtaaagatatgggagctgatgttacattagaaaatgtaatcgataatgggggagagccaacagcagatattgttgtaaagacaagtaaattaaaaggaacggtgattggtggagaagtcattccaacattgatcgatgagattccagttattgcactgttagcagcatttgcagaaggtgagacagtgatcaaagacgcggcagagttgaaggtaaaagagtctgatcgaatcgcattaacggttgataatcttgtgaaaatgggtgttgatgcgacagcgacagacgatggaatgatcatcaaaggcggtaatccattacatggagcaagcatcaattgtaaatacgaccatcgaatcgctatgacattttcgattgcaggaatcaatgcagaaggagaaactgtgatcgaagattcagaatgtgtggatgtgtcctatccaacattttatgaacagttaaattcattgcaataaataaaatgctatgataagagtttataaggagtagataacaatggaaaagaaatatttcttttttgatattgacggaacattgacagatagatcgacagggaagatcgtgccaagtgccagagaggcgttagaccgtttagaagcaaatgggcattttgttgcgatcgcaactggaagagcacattacaaagcacgtaaattcacagaagccaatggctttaaaaatatggtttgttgtggaggcaatggctgtgtgatcaacaatgaattagtggaaaatattcctttggataaagaagggtgtttacagatcattcatcagtcagaagaattagggtatggatggtgtgtagctcttgatgatacgaaagatgtctatatgacagacgataaatttctaagacaggttggaaagagaaaagaaccaaccagatatatcatcgatgatatgttagatattgacagtgtcgatgcgatttacaagatttatgtagctattccaaaagaggaagaagagaaacttacaaagaaaaagttgatcgggcatttgagatttgaaccagaatatttaatgttccagccagataataaacgtggtggtattgtgaagatgatggaatatcttggcgcagatattaaaaatgtggttgtattcggggacgattacaatgatatggatatgttctgtaaagactggtttgccattgctatgggaaatggatgccaggatttaaaagatatggcaagttatgtgaccgatacaaatgtcaatgacggtattaagaaagcatgtgaacattttgaatggatttaataaagtaaaacagcagacagaagatacatcggagggaaatatgaaacatttaaaattagggaagatacaatggatcgcattattggttgtcagtgcaatgtttgtgaatttatgcagccatatggtattggcagcagcaagagatggaaatgatccggcacagggaacaacggcagaagcaacaacagcttcagaagcgacaacagaagcaacaacagcttcagaagccacaacagaaactacaacggaacagcaggaagagacacagtctatgggagaatataaagcattctggttttctttctacgattatgactcttatcgtgcaaaatataaaaagagaacggcagcaaatttccgtacctactttacaggtgttgtcaaaaaaggaaagagtcttggaatgaatcgcgtgatcgtgcaagtaagaccatttggagatgccatttataagtcaaagtatttcccttggtccaaatatatttctggaaaacagggaagaaatccaggatttgacccattaaagatcatggtagaagttgcacatgacaatgacatgaagatcgaggcatgggtaaatccatatcgtgtaacaacaggttctacgaattataagaaacttgcaaagaataatcaggcaagaaaatggcatgccaagaagtctacaagaagaaatgtattatcttatggtggaagtttgtattacaacccatccaaaaaagcggtcagaacactgatcacaaacggagtaaaagaaatcgtacaaaattatgatgtcgatggaattcatatggatgattatttctatccatcttttacaaaacgtaatgtcaaaaaggcatttgatgcaaaagaatataagaaatcttcttataagaagaaaaagaaaagtatctatacttaccgtcgcgcacaggtaaatactcttgtgatacagatgaaaaaagcagtaaaaagtgtagatccaaatgtaacatatggtatcagtccagcaggaaatattgacaatctgacaagtaaatattcatattatgtagatatctataaatggctaaattctacagagtatgttgattatatctgcccacaggtatactggggatttaaacatccaactgcaaaatttaataaagtcacagatcgttggatcaaggcagcaaagagtaagaaagttaaactttatattggaatcgcagtatatcgtgcgggacataatgttggccagaatcgtgcagaacgaaaagaatggaagagtgatacaaaagtcttgaagaaacaggtccagtatgcaagagagaaacatgtggatggatttgcattctttgactatcaggatctaaagagcaagacaagtgccaaagcagtcaatcagctcaaaacagttttaaaataaacaggaaataaatattgcagagatcattgcatagagatatgtgatggtctctttttagttacagcagatttcttttcatgtaaattacactatataagaaatctacagcgagttgacataatatgaaaaatataatattatatgacgtataatatgatgtaaggaggatgccaatggtttttaatacaggagctgcgctgttagatgcggtagttctggctgtcgtatcaagagaagaagaaggtacgtatggatataagatcacacaggatgtaagagaagtgttagaagtatcagaatctacattatatccagtattaaggagacttaagaaggatggctgcttggaggtttatgataagcaatacggcggcagaaaccgcagatattataagatcacatctgtgggaatagcacagctttcgttatataaagaagaatggaaacaatattcccagagaatatctagaattttcgaaggaggagagagagtatgaaccgggaggagtacttaaagagattgtcttttttactaaaagatcttccaaaagaagaaattgaagatgcgatcgcatattatgaagattattttgaggaagcaggagaagagaaagaagaacaggtgatcaaggaacttggttccccagagaagatcgcgaagatgatccgtgattctgtacaggaaaatcaggcaagcagtgagtatacagaagaaggatatagacaggaaacttacgaagattaccagcagatgagtagaaaagactcacaaaaggaagccaaacagggcagcagatggcatatgaagggaagaagaaaccggaatatcattttgatgatcttaattcttgtctttgtgggaagctggctgattcctggtatttttggcattgtgattggaattgcaggaggaatttttggcagttgtgtgggattgttgtttggaggacttggactggtcggtgctggaatttataagatgtttacgacagttccatatggtttattgttgatgggcggcggttttctgatgatcgctggtggaattttgttattatggttccttgtatggatctgtgcaactgccattccatggattattgcaaagatccgtgaattttggaacagaaattttgggagaggatgtgaataagtttgaagacgtttaagaaagtatgcatgatattaatatcagtaacggctgttgcagggatcggatgcatcatagcagcatttgttatgggtgcagatccaagacagattcgaaattatgcagaaggaaagacaagcggtaaattacagacagaggaacgaaatataagagcagatcagatccgaaaattaaatattgatattggaagtggaaatgttaagctacaaaatggaaatcaggatcatctgatcataaagaaaaaaggaagctgggagccagtgatattaaagtcagatggagagattgaaatcaagcagaagagcagacattttaaattgttttggtttcaatcaaacgatgagatcacagttattctgcccaaaggagttacctttgagaaagtttccatggattgtggcaatggagacattgcgtcagattctttgaatatcacagacgaacttgacatagactgtggaagtggagatattgatctgacaacgatcacaacatcaaagacagagattgatctgggttctggagatgtcacattgacaatggcaggaacagaaaaagattataactataatatagattgtggaaatggagatgttaagattggagatatacttttcgaagatgatctaaaaaaacgaaatatcaatgcattaagatggattaatatagattgtggaagtggagatcttacgatcgatttcgataatacaatattgtaaaacaaagtaacagatagatggaggaaaaggaaatgaagaaaacattatataaatcaagaaaagaccgttttttatttggtgtatgtggaggattagcagaatattttgaggtagatccaactttggtacgaatccttacagcagcattatgcacaacaggaacaggattgttgttatatattgtggcagctgttgtcatgccggagcgtgtcgagtaattgtctttttcttgaatcaatccaaagaatgtgataaaatagacaatcatgtcaaaattcaggtcaaataagactttgatcatgaagataaatacacataaagaagaggagaaatcatatgaaattaccaatattgatcgcaatggttctctatatggcaatggttatctggattggtgtcatttacagtaagaagacaaagacatccgaagactatttccttggaggacgaggacttggaccatgggttaccgcaatgagtgcagaggcatctgatatgagtagctggctgttgatgggacttcctggacttgcatacgcaacaggattcagccaggcaggatggacagcaatcggattgatccttggtacatacttaaactggaagatcgtggcaaagagattacgtcattatacagaagtagcagataatgcgatcacagtgccagactttttcagtaaccgttttaaagatgataagaagatcttaagcagtatttctgcagtcatgatccttattttctttacagtatacaccgcatcaggatttgctgcatgtggtacattatttaactctgtatttggattaaattatcagaagagtatgatcgtctgtgcgatcgttattgtattatatacatccatgggtggattcttagcagcaagtacaacagacctgattcagggattattaatgtcatttgccattgtgatcgtactgatcgttggagttgtgaatgcaggtggagtagcgaatgttattgcacacggtcaggcaattgaaggattctttgatgttatgaagtaccatgatccagcaacaggaggtgcagtatcacagggtgtgattccaatcttatccggacttgcatggggacttggatactttggtatgccacatatccttgtaagattcatggcgattcgtgacccacaagaagtaaagaaatcaagaaatatcgcaatgatctgggtattgatttctttaagtgtagccgtatgtatcggatttacaggagcagcactttatcccaatgtagcagaattagctggaaatggaaatcagagaatctttatttatatgacaacacatttatttaaaggactgatcccattatttatggcaggagttattttatcaggaattcttgcagcaacaatgagtacatctgactcacagcttttaattgcatcatcctgcgtatcaaagaacttattccaaggattatttaagaaagaaatgtctgaagaaaaggtattgttagtttcaaggatcacaacgatcgtgatcgcattgatcggtatctttatcgcaatggatgaaaacagttctgtattcggactagtagaaaatgcatgggcaggattcggtggagcctttggcccattaacactgtttgcattattctggaaacgaacaaacttaaaaggagcaatcgctggaatgttaagtggaggtatcattgcacttgtatggccagtgactctgggaaaattaggtggaatttttggaatctactgcctgttaccagcatttatcgtatcttctattctgatcatcgtagttagtttatgtacagaagaacctaacgatgttatggtgaaagaatttgaagaagcaaaaagcctcaatgattaaattgtgatttgaatgacgaaaattattggtggaatattataaaaagagatcatatgtttgcaacccactcgcgttcggactcccacgtagctgtactaagctcctgaatggtctaatgaccatccactcgctaagtgcagacgtgtccgtacggttgccaacacatggtctctttttataatattcaaataatttacgttattcaaaccactacacagtgtgtatgttttactgtatgggcatttataataaacatttgtctgttactaaaaaatttgaaaaccgataacgttcaacatacaatacttaattttatacgagaatgtcttcaggtattcataaaaacataaagaaagatagaggtacgaaatattagaattccataggattttttgcaaaatcgcagccaacacgggcactgtttgaacgcagtgagttgtgcaggagtgttggcggatcagcgttttgcaaaaaatccgtcaatggaattcgtttttcgtacctctatctttctttatgtttttatgaatactcgatacatttccgttatacaacttaaaatttcaaagcacttttcttttttgtatacataccatgatagtataaaagaagaaaaggaaaatagaaatgaatcaatgttattgtgatcgatcatcaggaatgtgtgagtatggtcatcggcatggtggagtggattctatgccggttgctatgcagtatgttccatggcagcattggagcaggatttatagtccggaagaaggattacaatgtggaacgatctttccagagttgaataaaccattttatgggaaaggggcgtgccggtaatgaatcagtatgataagaaaaagttgttaaattatattgatgcagtcagctttgcattgattgatacgaatctgtatctcgatacacacccaaatgacaaaaaagcaatggaccattttaatcaatatcagaaggcaagaaagcaggcattaaaagaatatgcgagaaattttgaaccattgacgattgatagtgcagatatagatgatcattttacatgggcaacggattcttggccatggatgaagaggggaggttgttgatatgtggaattatgaaaaacgattggagtttccggtaaatatcaaacgaacagatcccaagatggcacaattgatcattacgcagtatggtggtccagatggggaattaggagcttcgatgcggtatttgtcgcagcgatttgcgatgccatataaaaatgtttgtggggtgctaaccgatataggtacagaagaattagctcacttggaaatggtctgtacgatcgtgcatcagttaactagagatctaactccagaacaggtgaaaaaatcagggtttggagcttactatgtagatcatacagcaggtgtatggccacaagcagcaagtggtgtaccgtttagcgcagcgacgtttcagtctgtgggagatccgattacagatttaagtgaagaccttgctgcagaacaaaaagcaagaacaacgtatgataatttgttaaggcttattgatgatccagatgttagagagccactgaaattcttacgagaaagagaaatcgtgcatttccagagatttggtgaagcactgaggactgtacaggatcatttggattctaagaatttttatgcgatcaatccagcatttgatcatagtggtaattgtaataaataaatatataaaaacagttggcataaaaagtaaaaattatgtcagctgttttttattttttgaagtaacaaaaagttgaaaatatatgacaatctgttataataaatcaaaaatgaatagttcaaatatgaattaattaataaggagggataaattcatgaagatcaatatagaatttccgagaaagttgttagaggtatataacgatgcatgtaagccgttatgcaagaaattaaaattaccacagacagcttttgatattttaatgtttttaggaaacaatccacaataccagacagccagagatatcgtaaagatcagaaatatcaaagcaaatcttatatcaatcaacgtagagaaacttgtgaaagaaggttatttaagaagagaagagattaaaggtgatcgaagaaaaacaaaactgattattacggaaaaagcacatccagtgatcaaagaaggacagcagttacaacaaggatttgtagatcagttgtttgataatacaacacaagaagataaaaaaatttttatccatgtaatgaaaaatatggataagaatttagatgatattttgaaaggtggaaactaagatgaatatattattaacaatcgcagtaacattttttgcaggaatgggagccgggcttggaacaggatttgcagggatgagtgcagcagctgtaattagtccgatgttgatcacattccttaagatggacccgtatatggcaataggaatcgcattgtcctctgatgtattagcaagtgcagtatcagcttatatttatggaaaaaataagaatcttgatataaaaaatggtatcatcatgatgataagtgtgctaacatttacagtagtaggaagctatattgcaagcttacttccagatgcaacgatgggaagcttttctgtatttatgacatttttattaggaattaaatttatcgtgagaccagttatgataaccaaagaagccatgcaaggagtttcagcaaagaaacgtgcaattcagtcagtggtctgtgggatcatgatcggattgatctgtggatttgttggtgcaggtggtggaatgatgatgttgctcattttaacgagtgtattaggatatgaattaaaaacagctgttggaacgagtgtatttattatggcatttactgcatttacaggagctgtttctcattttatgattgttggagcaccggattggacagtatttatcttatgtgttgtatttacgctgatctgggcaaggatcgcagcacgatttgccaataaagcaacaccagagacattaaatcgtgcgacaggtgtgatccttgtgatcttagggattgtagtattaggattttctatgctttcataaagaatacttacgaaggaaggaatttttaatgaagaaaaatctggttgtgatcgaggaattaaaaaaacagggaaaagcattattagatgcgagaagagataactttgtcagacaaagtcttttgtcagatgaatttttgaattttatgcaacaaaataagaagccgtttgatcttttaatgtcatattatgaatgcgcgatcatggaagtggaaacaaaattcagagtattaaatcatgaattatctttggaatatgataataatccgattgagagtattaagacaagagtcaaatcatacgatagcattttgaagaagatccgaagaaaaaatattccattaaatctaagggcgattgaagataatttaaaagatattgccggggtcagagttatctgttcatttccagatgacatttataaattagcagaaagtttcttaaagcaagatgatatcacactgatcgagcgaaaagattatattaagaatccaaagccaagtggatatcgaagtcttcatctgatcgtacaagtaccgatctttttacaaaatgaaaagaagatggtgaatgttgaagtgcaatttcgaacgatcgctatggatttctgggcaagtcttgaccataagatgcgttataagaaagagttgtctgatgaagaagtggaaatccttcaggaagaactttatgattgtgcaagacaaagtgcagcacttgatgagagaatgcagggaatcagggatcgtattacaaagaaacaagaacaggaaacgatattgttagaagataagaacagcaaagactggttataaaacataagtgtgacaaacgtacatataggagatatcatatatcaggaaatgatcatagatatctccttttttattcgtttccacattaatatggaagctaatgtaattgcaagaaataagatatcaatggtattctagttacagaaagaaaaacgttaattaacagattaggggtgattgatttgattcgtcgacaaatcgaattattaaaacttttgtcaaaacaaagggaatataaacccgcatctttctttagtaaatcattagatgtttcgacaaaaacgatttacacagatattacttatcttcaaagtgaagttgaaaagtataaagttgatctggtcagagctccaagaataggaattcgtctggaaggtgaaaaggaaaacattcagcatatgttaagagaccttcaaaaggataatctgtctgaagatgaaaaatatacaccggagtatcgcagattgtggattttaaagaaggtattgatcgattgtgaaacaatcacattggaatcagtatcaaaggaatttttagtaagtaaaacatcactgtatcaggacattgcagtgatcaataaatcaatcgaaagtcagtcagatgtaaaactggaagttggagaatgtggaatctgtattttaggagaagaaagcgagatacaaaatgcagtgaacaattatttgttatcagaatcaaaggaagaaatgttttctgattttacgcacaaacttggaaacttttttgaacttgatgtgataaaagcagtttcagatcttattttaaatgattttgaagaactgaccgaagtgctttcagaatattatctgaaatctttattggtaacattgatcatgcaaagttcaagattgctcaaaaagaaacatatgaatgaggaaacagaaatttcttacaacaatatccggcatatggagacatacatcgtggcaaatagtattgcggaacagctgaaataccagcttcatattacatacagtaataatgatatggaatatttatgcagacagttatatgcccacagagtgacacatcatgtaaaacatatgcggacagactatgaagaaacggtaagagatgtcatcaagagaatgagtgagattcaaaagcttgatctgacaagggacaagaaattatatgagtcattgttatatcatctgccaccgatgatcttaagattgcaaaataatattcagatcgtaaatccgatgcttgataatatcaaacaggagtatccggaactttttacaacgatgtggtatgcacttacacaaatagaattaaggtatcaggtaacattaacagaagatgaagtttcactaatcttattacattttcaagtggcattagaccaatttgaacaagttggaaatattgttgttgtatgtacctatggagttagttcttctcagctcattttaagcagggtaaaacaaatacttccggcaaaagataatattacggtgacaaacacaaagaaattaaaagagatcgatcttagtaaagtagatctgatcatatcatctgttgatattgaggatccagagatttcttatgtgaaggtaaatccgctgcttacaaaagatgattatgccaatatcctagatgcatatacaaaacaggtattactgatcaaaaataatgtgtgtgataaccagaaaaatggaattaaagcaccgacattgaaaaaatatttggaagggaaatttattttccttaaacaagatcttgatagtaaagaaaagtgtctagattttattattgatgtattagaaaaagataatgcagtgtatgatgaatttagggaagctatttacaaaagagaaaaacttggtgtgacatgtttggatacaggtgtggcactgccacatgcagatccgcagacgattaaaaaatccagaataatcctattaactttaaaacatcccgttgactggggtggaaatttagtatcactgatcgttgtaactgcatttccagaagaagaaatgaaccagattcgggatgtgatcactgaactctatcagcttattggagaaaaagaagatgtaaatgcgtttataagattcgaaacaatacaagaagttttaaaagtatttcatgaatcatgatatgaaaggagaacttgaatgtattttgaccagagattgtgtttctttcatcaaaaagtggaaagtcaggatcagttgtttcagatgatgacagataaaatgttagaagcaggatgtgtaaaagaaaattactatgaaggaataagtaacagagaaaaagaatatcctacaggattattagtaaatcagacaggctttgcgattccgcatacagactctgagcgagtgaataaatcgcagatttgctttttatcattagatgagccaattgaatttgaagatatggtggataaaagtcataagatttcagtggaattggtatttatgttagcaatggcacagccacatgagcaggtaaatacattacagaatttgatcgcactgtttcaggatgatgaaaaagtagcaaagttgaaagaatgtaacacagagaaagaacttatgcagattttaaatgcatcaggaattgaataagcgatagagaaagagagaagaagaaatgttaagtgtattacaatggtttatcggattagggtcaacggtatttttaccgatcattattttcatattaggtattatttttggagtaaaaccagcaaaagcagcgatttcaggttttacagttggaattggtagtattggtctgaatctggtcattggattattatcagataaccttggaacggcaatacaggtaatgggagaacattacggattttcactaaatattatggatattggttgtggtgtcggtggaccgctggcattctcaacaacatttggaattatattgatcccaatgtcattgatcgttaatttattatttgtcatgcttgggtggacaaaaactttaaatgtagatatctggaacttctggtttccatgtttccttggattagttgcacaggcagttacaggaaattttgttacaggaattttaggagcactagttgcagttatgcttcagtggttattagcagacattttccagaagaaagttagtgaattttttggatatccaggaattgcaatttctcatatgatggcgttatcaggagcattgatcgcagtaccattaaactggatttttgacagaattccgggatttaataaaattgaagccgactcagaaacgatcgcaaaacgttttggattttttggagatacagttgttatcggaatcatcattggaatgatcgtaggattcttggcaaaatatgatttcgcaaaagctgcacagttaggaatggcaacaggtgcggttatgaaaatcatgccaaagatggtagcaatgtttatggaagggttaatgccaattgcagaagctgccaaagaattcgccaataaaagattaggtggaagaagtgtaaatattggtatggatgctgctctaactgttggacattctacagttatgagtacaaacttattaatggtaccaatttctttagcattagcgattatcttaccaggaaaccagaccttaccattcggagatcttgcattctatgcatttggaatctgtctaatgatcccaatttttagaggaaatgttgtgagatctattgtaggatgtagtatttatatggtatctatgctgtatctttctacatggcttgcaccaatcattacaaatgtatttaagatcgcacattataatgttggaacaagtggacaggtaacatccgtactttgcggtatctggccagcgggattattcgcagttgcaacaaaatcattagggaatattggattagcagtgattggagttgtcgtgatcgcattactagtatatgtaaataaaatcagagcacagaaagaaaattagaatctttataaaataagatatttcataggaggtagtatcatgaaaaaattattaattgtatgtggagcaggacatgcaacatccacaattgcggtagcaaaagtcagtgcatggttagaaaaagaaggatacagcgataaagtaaagatttatcggtctaagattgccgacgaattaaataaaattgatgattatgatgcggtgatatcaacaacgatcgtgccagattctatcaaagataaagtcattcagggattaccattattaaacggaatgggagtagatcaggtatacgatcagttaaaaacaagacttggattataggagcagatcatgggagttttttttggagaagtgacattagaaacagttaaaggaagagcatcttatcatgacatttctgatgaaatcagagaaaatatcaaaaaatctgagttaaaaaatggatgtgttgtcatatcaagtgcgcataccacatgttctctgtattttgacgaatgtatgcatgacacaaattactggggagatgaatatctgcaggcagatattaatgatgtgatggaaaaaatcgcgccatccatgaaaatggaaaatcagtatcatagtccaggaccaaaacatattgaatttggattaagtcttggatctaaggattatccagcagaaaaatggacaatgcttaatacagatgcacatctgaaatcttccatttttggcagcccgtcattaacatttattgtaaaagacggagaaatccaacttggagctttgggaaaagtctattttgtagactgggatcagttaagagaacgaacaagaaaagtacagattatggtgatgggagaataaaaatgaaaattatcagtccttcattattaaattcagatacatatcagattaaggagcagtttgaagcattagaaaaatgtggaataaactacattcatattgatattacagatggacattttgtaccaatgatctcatttggcgcaaatacagtaaaagatctgagaaaacatactgattttgtactggattgtcatctgatggttgaaaatccagaaaatctgataccagtgattgcagatgcgggggcagatatcatcaccgtgcatacagaggcaacgaagcatatctaccgatctattcagacaatcaaaaagtgtggaaaaaaagccggaattgcgatcaatcccggaactccggtatctatgatcaaggagattttgccaatggctgatcttgtcctttgcatgaccactaatcccggtgtgtttggagaaagttttattccatcagttgcagacaaagtaaagaatctttgtgaattgagagaacaaaaaggatattcttatcagattcaggtagatggaagcattaatgatcaaacagccattgtgtgtaaaaaggcaggcgcagatatttttgtttcaggaagctatatatttggaggaaatatcgaagaacgaattcacaagattatggatgcaggagaagagatgtgaaagtaaaagaaaatttagaacatattttaaaggaacttcaagacgcaacttttaaaatagaagaagaacagattgaaaatgttttaaaactgatagcaccagacaaaaagatatttttaactggaaaaggaagatcagggttggcggcgaagggttttgcaaacagattgatgcatcttggatttcaggcgtatgtcattggagaaatttcaacaccacatacgaaagctggagatctattgatcataacatctgggtcaggagaaacagatgccttggtcagtattgcaaaaaaagccaaagaatctggattatatcttggacttgttacaatgaatccgcaatccacactggggaaaatggcagatgggatgatcatacttccaggtgactccaaaggaaataatgaagagaaacattcgatacagccaatgggaagtcagtttgaacagatgtcatttttaatcttcgatgcgatcgtattaaaacttatggaaaactggaatcagacatcggagcagatgtttatgcggcatgcagatttagaataatgatatccatgcgttgaaagatgatgtgtgggaagaaaatatcctgtaagatcagataaattatgtttggtcttacaggatatttttagatgtcataattaaaaggatatttcttaaattgtaatttctgacagactgtgatagaataggacaagtattaaaaaaagtataaaaatttgttaagaaagtgttaatgaattgagggtaaaaaatgaatattatcattgttgggtgtggtagaatcggttctacgcttgttgaggaattaagtggcgagaaccatgacatttccattattgatgagaaagcacatgttgtacagaaacttgctgaaacacatgatgtattaggtgtgatcgggaatggagcaagttatagtattctgtcagacgcaggagttgagacagcagatatcattattgcagttacgaactctgacgaattgaatcttttgtgttgtctgatcgcgaagaaggcaggaagatgtgagacggttgccagagtgagaaatcctgtttattatgatgagatcagtttcataaaggaagagatgggaatttctgttgtgctgaatccagaattaagtgcggcatatgagattgcaagattactgagattcccttctgcaatggaagtgaataagttttctaaaggcaggatcgagatgttaaaataccgtatcccacataattctaaattagatggaatgacattgatcgatgtcagtaatcagttaaattgtgagatattgatctctgcggtagagcgtaagaaagaattgatcattccaaatggttcttttcagttaagagagaaagatataatttcatttgttggaaggccaaactgtgcaatggaatttttcaggaagattggggaaagaaagaatcaggttcatgaagcaatgatcataggtggaagtaagattggattttatttatcaaaattacttgtttctagtggaattggtgtaaaactgatcgataaagacagagatcaatgtgagagattaaatgagagtattccagatgcgatgatcatccatggaaatggaaatgaccatgatatgctgttagaagaaggtctgacggatgtagatgcatttattgcccttacgaatcacgatgaggagaatatgtttctgtctctgtatgcacagagccagagtgatgcaaaattggtcacaaaggtacagaaattgaattacgatgccatgatcgaacgattagatcttggaagtatgatctatccggaatatctgacagcacaatatattattcagtatgtaagagcaagacaaaattccatcggaagtaatattgagaatctctacaaattaatggatggaagagcggaagcactggaatttcatattcagaaaggttctccagtcattggaagaccaattaaagatctgttattgattgataatctgctgatctgcagcatttatcgtaaaggaaaaccaatgattccaaatggtcaagatcatatggaagaagatgatctggtggtagttgtcacaactaaaaaaggattacacgatgtcaaagacatcttaaagagaggataatgggggcagggtataatgaatttttcaatgattcgatacgtaataggcttggtaatgctctttgagagtgcatttttatcacttccttgtctgatcgcattaatctatcatgagaagaaaggtttttctttctggatcatgctatttgtatgtctgatcatcggaattctttttgttatgaagaaaccaaagaagacagtttattatgcaaaagaaggttttttaacagttgcgatcagttggattgtgatgagtttttttggagcacttccatttgtgatcaatggagatattccatcggttgtagatgcgatgtttgaaacggtttcaggatttactacaacaggatcaagtatcttaacggatgtagaagcattagcaagatgtagtttattctggaggagttttactcactgggtaggtggtatgggtgtattcgtgtttgtattagctgtcatgccattggttggtggtcagaatattcatctgatgagagcagaaagtccaggaccatctgttggaaaactggttcctaagattcgaaaaacatctatgatcttatataagatttatatttttatgactattgtgatggtagtattgttgcttttaggaaagcttccattatttgattcgctgttacttgcattcggtactgctggaactggcggattctcgatattgaattcagggtgtgcatcttactcaccatacatacaatatttgatcgcgatctttatgatcttatttggagtaaattttaatgtatattattttattttgatcaagaagttcaaagatgcgatccattatgaagaattaaaatattacttattatttattggtgcatctgtagcaatgatcacatataatatacacagtttatttccaacgatcgagcaggcattccgccatgcactttttcaagtaggaacagtgatcacgacaaccggatatgcatcaacagattttaataaatggccggaattttcaaagtttattctggtaatgctgatgttttcaggagcatgtgccggaagtaccggtggtggtatgaaagtatcaagattggtcattatgttaaagaccgtcaagaaagagctgctctcatacttacatccaagaacggtacgtaaggttaaattcaacggaagaattgtagaacatgaagttattcgagggatcaatgtttatatgatcgcatatgcatttgtactgatgttttctgtactgatcatttctattgataacttcgattttacaagcaattttacggcagttgttgcaacattgaataatattggtcctgggcttaatatcgtaggaccaactggaaacttttcaatgtattcgaatctttccaagatcgttatgatctttgatatgttagcgggaagactggaattatttccaatgttattgttgatcaatccatatacatggaaagaaataaaaataagaaaaaataaaaaaaataagaaagagggccatagcatatgaaacgtaatacagattttatgcttcgtgatatcgcaggagaagtaattcttgtaccaacaggggctgcaactcagcaatttaatggaatgatcacattaaatgaagtggcagcatttatttggaagaatttagatgaatcgaagtcaaaagaagaattggttgataagatcatggatgaatttgaagtagatgaagaaacagcaaggacagatgtagaaggatttgtcggagcactttatgaacatggactggtattggatgaatgagacagattgcaaataacgtttatatcccggtattgaaagatctggtagaagagggaaaagaagtcagcatgatgatcagtgggagcagtatgaatccgtttttgatccatcaaagagactatattttgatgaagaagccagaagaagaattgaaagctggggatatggtgttttttcagagaagagatgaggcgtatgtgatgcatcggattcatcacatcaacaaggagggaaaactgtttattatcggagatgcacaggtagatatggaaggaccgattgacaaagaacaggtttttgcgatcattacaaaagtaaagcgtaaaggaaaatggatcacacctggagatttttggtgggagttttttgaacatatctggcttcatttgattccatttcggagatttttgatgaaattatacggaattcgaagataaagggtggtaatattttacgtattaccattctttttttgttatcagactatgatgagagtgtcaaaagtaaattttgccactctctgatgcatccagattgttccattgctacgcaattccgcaatcttcgaacacctcgaactcccataaaatggtgtattcacaccattttattccgttctcgttgttcggtgtgtcaataaatataaattgcttatttgtgcaagcacaaacgcaatttatacttttgacacttacatcattttatagtatccttaaaaataaaagatacaaaacaggaggaagatcaatgggacgtgtatttaaattccataacgacgtagatacagatcagatcatcgcgtcacaatatttgttattgccaaatattgaagagatgaaagtatatacttttgaatcaattgataaagattttgccaagaaggtaaaagaaggagatattgttgtagcaggagagaactttggatgtgggtcatccagagaacaggcgccaagtgtactgaaagcgttaggtgtcaaagcagtggttgctaaatcatttgcgagaatcttctatagaaactctatcaatatcggattaccagtgatcatcagcaaagacttatatgacaaagtggaagacggagctgacattgatatcaacctgtctgaaggatggatcaaaacagaggatgaaacccttccatgtaccaagctgccaccatatatgcagaatatcttagatcatggcggattgatcaatttcttgaatgaaggggaggaataggaacatgggaatgaccatcggagaaaagattattgcaagagctgcgaaagtagatcaggtaaaagcaggagaaatccatacgatcgaagttgaccgtttaatgagtaatgacggaacgacacatttaacaattgatatgtatcataaccagttaaaacatccaaagatcgcggacaaagacaaactggtatttatcatggaccacaatgtgcctgcggagaatccaaaaacagcagcagcacatagaaagatgcgtaattttgcaaaagagcatgagatcaaattatatgaaggaaaaggtgtctgccatcagatcatggtagagaatcatgtatgtccaggagaatttatcatgggtgcagactcccatacgtgtacatatggagctttaggagcatttggtacaggaatcggatgtactgatttcttatacgctatggtaacaggacagtcttgggtattagttccagacacgatccgttttaacctgcatggtaaattaagagaaggtgtatacgccagagatttaatgctttctatcatcggaatggttggagcaaatggatgtaactacaagatcatggaatttgctggagaaggtgctcataaccttgatattgatgaacgtttagttctttgcaaccttgctgttgaagcaggagctaagactggaatcgttgagccagatgagaaagttgtagaatacgtagaaagtcgtggaagaaaagctgagaacttattcaagagcgatgatgatgcggtatttgagaaagtttatgatatcaacttagacgagatcaaaccagttgttgcaagacctcatcagatcgatgatgttgtggatgccaaagaagtcaaggatgtgaagatcgatgaagcattcttaggatcatgtaacaatggacgtatcgaagaattaagagtcgctgctgaaatcttaaaaggtaagaaagtaagtgacagcgtaagatttttgatcgcaccagcttccaatgaagtttatatgcaagcattagatgaaggtctgatcgatattttcatggaatctggagcaatggttatgaactgtaactgcagcgtttgctggggaagctgtcagggtgtcatcgggaaagatgaagttttgatttctacaggaacaagaaacttcaaaggacgtgccggacatccggattcttatgtatatttaggatcagcagcgacggtcacagcatcagcgatcgcaggtaagatcacaacagcagaccagatttaaggaagaaggatagaatagatatggaacagtttaaaggaaaggtttgggtgcttggagatgatattgatacagatatcatcatcccaacagaatatctggcacttccaaccgtagaagatatgaaacagtatggattttctccacttcgtccagaactagcaggacagatcggtgaaggagatattatcgtagcaggaagcaactttggatgcggttcttcaagagaacaggcaccagagatcatcaaagcattaaaagttaaatgcgtcattgccaaatcatttgcacgtattttctttcgtaattccatcaataatggattactgttaattgagaatgacaagattcaggatgcagttaaagaaggtgatgagattgaagttactttaggagagaagatcacatataatggtacagattatgagatccattcccttccagataacttgatggagatcatcaacgctggtggattagtagaagccatgaagaaaagaaatggggtgaaataaagatatgggacagacaatgattgaaaagatcatcagcagaaacgttggtgttgacagtgtaaaaccaggacagatccagacagtaaatgtagaccgtgttatgatccatgatatctttattccattcgtagcggagaaattcgaagaaatgggatttacaaagttatgggacccagacaaagtcgtattgatctatgaccacatggtaccagcaagtacaacagacgatatcagacatttcaagatcggtgatgcatttgccaagaaatatggcatgaaaaatgttcacagaagtgatgggatctgccatcagttaatgacagaatgtggatatgcgaaacctgggaatatcgtattcggaacagactctcatacaacaacttatggttgtgttggatgtttctcttcaggaatcggttatacagagatggcagcgattcttggaacaggagagatgtgggtaagagttccagagacgatcaaagtagtcattgatggaaaacttcctgaaaatgtaagttctaaagatattatcttacgattgatcggagatttaacagcagctggagctacttataaagcattagaattctctggaagcacagttgatgagatgagtgttgcagccagaatgacaatgtcaaatatggcaatcgaagcaggagcgaaagcagcacttttcgcaccggatgaaaagacagctgaatattctaaggtagatttagctgatgttgattggttatatggagatgaagatgctgagtattgccagacaatcacatataaagcagaagatttagtaccagtagtggcatgtccatcacaggtagataagatcagagctgtcaaagaagtcgaaggaacagagcttgatcaggtatttatcggatcttgtacaaacggaagattagaagatctgaaagcggcagcagagatcttaaaaggaaagaaagttgctgattatgtaaaattgatcgtaacaccagctagtagaaagatttataaacaggcagtggatgctggatacatgaagattttggcagaagccggagcgatcatcacgcatccaggatgtggattatgttgtggacgtgcaggcgggatcatgacagatggagaacgtgttcttgcaacaaacaaccgtaacttcttaggaagaatgggaacgtcaaaagtagaaatctacttaggatcacctaagacagcagctgcatcagcaatcgcaggtaagatcgtagaagcataaagtgaacatatgaggtaaagatcctcataaatataaagaaaaagtacattgggggtcattaggactcccatttactatgtagatggagttttttatgacaaacttattaatatcattatttattaaagacaaagaaaatgtaaaggatgcaaaagtaagaaatgcttatggaaagatggcagggattgtaggaatctgttgtaacatcttcttatttgcaaccaaatttttcgcaggaatcattacaggagcaatctctatcacagcagatgcgtttaacaatttatctgacgcagcatcttctattatcacacttgtcggatttggaatggctggaaaaccagcagatgaagatcatccattcggacatggaaggatggaatatgtatcaggacttgttgtatctatcctgatcttgatgatgggagtggaattatttaaaacatcagtagaaaaagtgattcatccagaggtgatcacagaacaatggatttcttatgtaatattagtgatctcgatcgcattaaaattttggatgtatatgtttaacaaaggaatcggatggagaattcattctgaaacgatgaaagcgacagcagcggatagtttaaatgattgtatttcaacagcagcagttgttggaggaatgcttgtattccattatttccatttaaatgttgatggaattgtcggaatctttgttgcatgttttgtactctggggtggttatgaatcaatcaaagataccatgaaccccctattaggagaatccccagatccagaattgatcgctaagatcacagagactgtattaaatcataagatggtcatcggagttcatgatatcgttgttcacgactatggtccaggaagaagaattgtctctttgcatgcagaagttccatacaataaagatatgatggaagtgcatgatctgatggatcatattgaaatgcgtttgatggaagaatatcactgcgaagcaacaatccatatggatcctgtagtgacggatgatgaggaagtgaatgagacaagaaaagaagtttttaatattgttaagaaatatgacaagacactgtcagttcatgactttcgaatggtcaaagggccaacacatacgaatgtgatctttgatcttgtgattccttatgggaaagattatgagccagagaagatcgtgaaggatcttaagcagaagattaaagacgagatgcaggggaaacattatgcagtgattcgtgtagacagattctgatttgtaggtaggcttacgcgtatgtgacagaagatgaaagggcttaaacaagcaccgatttgttaaaatatttgaaatataaacctagggatgtcaaattaatattatataaagtttaataaatgaaatattttgattgaataagtatatacaatttgataaaataaaaacaggtgttacttcacattgacgtgaatggcggtttgcttcctacggggagttctagccccgattacatagatcaatctctattattgagaaatcttacgaaaagggggcttgaagttatgctaaccattacagaactaattgcagtgatttcgctgtgtgtggctttttatagtcttggttatgtgcgtggaaagcatgatgccaagatagagaaataaccgcccattgacctgacaagttatgtgagcggttattcaatcgtttatatcaggcaaaccgtcatcggtagcaccttttctattattatagtaacatttatatatttttatgtcaattaagatgattaaaaatataagtgtgtgttagtatatataagatcaatatgactggacagcatcttaatctttctctaaaagctgagcaataatcgaattaggaagtacatctttcaaaacatccagacaagaaaaatcagtcctgctatttggcagggcttttttcgtaatacgaaagcccatcttctgatacataccaacagccttataagcccaagtatgcgtgtgaagaaaaataaaattagcatctggctctataataagaaaacgagacaaagcaaacaaaacaattgccttcccaagccccttcccctgttctttaggagaagtagacacccaatgaatcaaaggaaaccgaatatcgccatttgtcttaaaccaagcactcgtcgtagcaacaatctctccctcaggattcacaataaaacaaacccggtcagctaaaagttcttcatgagttaaaaaagttttagcaaaataagcagaagcatcctcaaaacaatcaaactctccaaccaacacttcaagcttcgcccaagcaatctcatccccagattcaaacatcttataagaatatccatcaggcaaaacaggaaccttaagatcctctaaatcctcaaaaggcagacacatcacaatatctttataaacaagagacttatcaagcataaacaaaaacccccataaaattaaaaataacaataaattgattaattagagtatacaagctattgaatgaaaagtcacggagtataaattaaacagaaagtactttctacgaatctaattttgatagtgatggagggaagtctaaaaaattattagacatcgatttagcgagatatttggaaaatcttttatcttaattcttacaagattaaaatgagagaatttcagttttcgattatcctgaaaatgtaaagcaatatagtaaaacatacatactgtgaattttgatttattggatttaatacctgtaaactttaggtatcttaggaaaacaaaataaaagaatagaagatccagaaccattgaaattttgccgttattttgaccggttcgcagcaaatttggtgcattgtttgaactcgcgtagcgagtgagttatgcaaggaaaatttgcgaatcagcgaccggtcaaaatggcgagcaaaattttgatcagccccctgtcaagtagacaggtaaaataattaaaatttcaagaaaaaacctacatttctatttgaggtgtaggtttttttctatgcacaccattttgctttatatttattgattcgtttgttctcaggtataggatactcttttgcaatgtctgatgttaaagcttctattcgaacctctaacggagttttattatggtatctgtcttgaaaacgttcttctctataaaatcgtatataatctctaattgcatattttaaagatgtttcatttgttattgtatacatctgatacatttctgattttataattccccaaaaaccttcgattggtccattatcaatacaatgtccaacacgcgacattgaatgtttcattttatgatcttccagttttgttctaaatgctctgtttgtatattggaatcccctatctgaatgaagtacaggttttgcatttggattttcatgcaatgctttatcaaatgttttaaatacaagtctgttgtcatttcgtttactgataacaaatgctataggatatctatcatacaaatccagaatagcacttaaatataacttcttatttcgttctcccggaattttaaattctgttacatctgttacccatttttgatttggctcagttgcatagaaatctctttgaagtatattttcaacggtttcttctggttttattgccagatattttttcttcttttttcggataattgcatgaattcctaatttcttcataatacgatgaactcttttttcactataattactttggttaagacggttaatccagtttgtcattctgcgataacctaagatatgtccaaaacgatcatcatattctctgatcagttctgctaactttatattctctttttcctgttcaggaatacatctgtgaatccatttgtagtaagctgaacgtgcaattcctaattgtttacacatccaattgatactccaatgatgttccttataaaaatattgcactgccatatattttgattcatgacgttgttttccgagcctcacatcctttcgaattctttcactttttttaatagttcaactgccatatctttttctttaagttgacgttttaatctaagattttcacggcgtaatcgttctaattcatcgacttcttcatctgatttatggtaacctcgtctatcacttaaagcactttctccttctgtttcatatttttttacccatgaataaacctgtctatatgaaactttgtataatgcagctgtttctttgtagtttttatcatgggcaatgcaatactgcgcaatttcttttcgttcttccaaagtagtttttcttttagctgttgacatataaacctcccgtataggtatataatccttaagttttctattagaattatataatgaaacccagcgaagtaaaacatctacacagctaatatcatattttgcaacaatattaacagcagaatcctttcctgaaagatattcttcaacagctttcattttaagttctgatgtataagttctatttttacggtgtaatccttctctaccatgtaccttatactgttttatccatcgttgaaagcaaccaggtattgcatgatatcctaattcatgtgctttttcagataatgtaaaatcaccatttaaatatccttctacaatatttaatttttcttcatatgtatattttcttgccataaaaatacctcctaagtagattgtattatttatcctgtctacttaggaggtatcatatcatttctggtctggatcttctattcttttattttgttttcctaagatacagaaagactacagctattacaccagcaaattaaaattcctcttgacacttcccttacgtcaccctttatgataacgtatagagagaaaaccaaggaggaatctaaatgacaaaagatggatactacacatccggtgaatttgcaaaaaaagcgaatgtaacactaagaacgatccgctactatgaccgtcaaggcatcttaaagccaagtaaagttgcagacaatggatatcgtctttatacagatgccgattttgccaaattacaaaaaatcttgtcattaaaatacctcggattttctttggaagagatcatgacgatgacgatcaacgatgaagatcaggatttcattaaagaatctatcggcttacagttataccttgtacaaaaaaagatggaacacttaaaactggtagagcaatccttagaagagatggaacaaaagatggataatgaagaagaaatcgactggacacagatgatgaatcttcttcacgtaaccaatctggaaaaaggattggtagaacaatataagaatgcatcaaatcttgatatccgtatcggacttcatcaaaaatattcacaaaatccacaaccatggtttgaatggatttatgagcagttaaacttaaaagaaaaagacaaagtattagaactaggatgtggaacaggggaactgtggaagaataaaaatcttccaaaaaatgtccatgttactttatccgaccagtcacaaggtatggtaaaagatgccaggaactatgtcggagagggaaaaggacagatttcttatcagatgatcgactgtagacagattccaaaagaagatcacagtttcgataaagtgatcgcaaaccatgtattattttatctggatgaccgacaacaagtatttaacgaaatcaaaagagttctaaaacaaaatggaacatttatctgcagtacctatggaagcagtcatatgcaggaaattacccagctgatcaaagattttgatgaaaggatcacgctttctgatcacaaattatatgatgtctttggtctggaaaatggagaagaacaattaaaaaaagtattttcacaagtaaaagaaattgactatgaggatgaattgttagtcgatcagccagaaccactgatctcctatattttatcctgtcacggaaatcagcatgaatatttaaatcatcgttatttagaatttaaagactttgtaagaaagaagatggcagccaaaggagtgatcaagatcacaaaatctgccgggatttttatatgtaaaccataaaggaggagttatgagagtttttgtcacaggagtcaaaggacagcttggttatgacgtaatgaacgaactagaaaaacaggggcttgaaggaattggtgtggatattgatgaaatggatatcacagatgccgatcaggtaaataaagtgatcaaagaagcagcaccagatgcagtgatccactgtgcagcatacacagccgttgatgctgcagaagataacgaagaaatctgcagaaaagttaatgcacagggaacagaaaatatcgcaaaagtctgtgaagaattagatatcaaaatgatgtatatcagcacagactatgtatttaacgggcagggtgagcgaccttgggaaccagatgataagagagaacctcttaatgtctatggacagacaaaatatgaaggggaacttgctatcgaagaacatgtaaagaaatttttcacagtccgtatcgcctgggtatttggagtgaatggaaagaactttatcaaaacaatgttaaacttaggaaagacacacgatcatttaacagttgtcaatgaccagacagggtcaccaacatatacatatgatcttgcaagattgttagtggatatgatccagacagacaaatatggaagatatcatgcaacaaatgaaggaatttgcacatggtatgaatttgcctgtgaaatcttcaaacaggcagggatgaacgtatccgttgcaccagtcagcagtgacgaatatcctgcgaaggcaaaacgtccatctaacagcagaatggataagagcaagctgacagccaatggatttacaccattaccaacatggcaggatgcattaagcagatatttaaaagagattgaatattaaaataaaaaggagaacgattatgggaaaaattacagtaacaccttgcgatattgaaggactttatgttattgaaccaacagtatttaaagatgaaagaggatatttcgtagaaacatataaccagaacgacatgaaagaagcaggacttgatatggtattcgtacaggataaccagtctatgtctacaagaggcgtacttcgtggattacatttccagaaacagtttccacagggaaaattagtacgagttgtgcgaggaaaagtatttgacgtagctgtagacttaagatctgattccaaaacttatggaaaatggttcggtgtagaattatcagcagaaaatatgaaacagttctatattccggaaggatttgcacatggcttcttagtattatctgatgaagcagaattctgctacaaatgtacagatttctatcatccaggagacgaaggcggtcttgcatggaatgatccagaaatcggagttgaatggccattagaagaaggcgttgacttgatcatttctgaaaaagaccagaaatggaaaggtttaaaagacacatttaagttttaattattacccagagggagaaagggaacacaaatgaagggaattattcttgccggaggttccggtaccagactgtacccattaaccatggtaacatccaaacagttactgccaatttatgataaaccaatgatctattatccattatctgtattaatgaatgcaggaatccgtgatattctgatcatttccacaccaagtgatacgccaagatttgagtctttgttaggagacggacatcagtttggagtgaacttatcttatgcagtgcagccatcaccagacggacttgcacaggcatttatcattggagaagattttatcggagatgacagtgtagctatggtccttggagataacattttccacggacatggattgaagaaacgcctgttacgtgccgcaaataaaaaagaaggagcaactgttttcggatactatgtagatgatccagaacgcttcggaatcgttgaatttgattctgatggaaaagccatttccattgaggaaaaaccagaaaagccaaaatcaaactactgtgtcacaggattatacttctacgataacaatgtcgtaaaatatgcaaaagaattaaaaccatctgccagaggagaattagagatcacagatttaaataagatctatctggaaaaaggtgagttagatgttgaattacttggacagggatttacatggttagatacaggaacacatgaatccttagtggaagcaacaaactttgtaaaaacagtcgaaacacatcagcacagaaagatcgcctgcttagaagagatcgcatatttaaatcactggatcacaaaggaccagttattaacagatattgaaccattaaagaaaaaccagtatggacagtatttaatggacgttatggcaggaaaatttttagataaataaggagaatagcatgaaaatattagtaaccggtggagccggatttatcggtggaaactttgttcatcatatggtaaacaaatatcctgattacgagatcgtaaacttggatttattaacatatgcaggaaaccttgaaacattaaaaccagtggaagacaaaccaaattacaaatttgtcaaaggtgatatcgcagaccgtgaatttatcatggatttatttgaaaaagaaaaattcgatatcgttgtaaacttcgcagcagaaagccatgtagaccgttctattgaagatccatctatttttgtaaaaacaaacgtagaagggacagtcgtactgttagatgcagcaaagaaatacggtgtaaaacgttaccatcaggtatctacagatgaagtatacggagatctgccattagaccgcccagatttattcttcacagagacaacaccactgcacacatcaagcccatacagcagttccaaagcaagtgcagacttatttgtattagcttaccacagaacatttggacttccagtgacgatctcaagatgctcaaacaactacggaccatatcatttcccagagaagctgattccactaatgatcagccgtgccttagcagacgaagaacttccagtctatggaaaaggtgaaaatgtccgtgactggttacacgtatctgaccactgtgaagctattgatctgatcatccacaaaggaaaagtcggggaagtttacaatgtaggtggacataacgaacgtactaacttagaagttgtaaagacaatcttaaaagcgttagacaaaccagaaagcctgatcaaattcgtaacagaccgtccaggacatgacatgcgttatgcgatcgacccaacaaaactagagacagaacttggatgggaaccaaaatataactttgacacaggaattgcacagacgatcgaatggtacttaaataacaaagaatggtggcagaacattttatctggagagtatgcaaactatttcgataagatgtacggaaaccgcttataggagtctgtatgagagtacagaaacagacaaaacgagtgttatactgggggataacactcgttttgatgattttgattttttcattttctgcaaagaacggcacatcctcagcagggatgagtatcggatatgcgaaagaacttgcaaggatcctaagctttcttggatttttccagattcattctaatgctgatcttatgatgcatgcagaaacggtgcatacgtttgttagaaaaacagcacattttacggaatatgcagtacttggattctttacttataaggcggtgtcatgtgatgtgctagatcgaaagaaagcagtattgaccgcacagttgatttctacaggatatgcatcaacagatgagattcatcagatgtttgttccaggacgagaaggaaaagtatttgatgtgatgatcgatagctgtggggcgttttgtggaattatggtatctttgatcacgcagaaattgatagagaaaaagaaaggaaatcagatttaagatgtctgatttcctttctttttcatgctcactaagctggaatccaattcccgatccatttttttgttgtttggttatattttcttttgtataatttcccgttcatagttttatatttccaaacgatgacatcgccgctgtatacagaggaatcttcttctgaaacagcaatggaaggttcgcttacggtatcttgggctgagacgattgagccagaaaatacaccaatagagataaaactaagtaaaaatagaaaaataaatttatttaatgttttcataaaatttcgtagcctcctttttgctagaatatattttaggacctttataatcttcagggttttcaatgattcctgcatttataaaagcatcttcatgtttgacatacaaatcatagcccttactatcttttcgctttatataaaaagaattactgctgtcaggtttatcaaaaataacagtgccatcattgtcatagcttggagctggcgaacgtggctgaaagataaagcacagcgaaagggtgaacaataaagaaatagatccaatatgtataaattgtgaaaataaatttctgcgaatctttggactatcattgataagatcgcatcttttctcaatgtttaaaatcgtaccttcctgaaaatgcagtgttggaagggtgtggaacgtatgagtctgtttggaagtattgagaagacttaacatataatttgttcttgtaagttcatctctgtctttggtaagtcggatatcatttgcatattccgcagtatctttgatcagacggcgaatcatataagaaagaggattccaccagtagatacatacaacgagttcccagaaaaaaatcttccataagtcatggtgtagataatgattgagttcatgcataaaaataaaacgcagatcctgatcactgtattctctgtcaggaagaaggatcactggatggatcagaccagaaattgcaggactagaaaggacaggcacctgatagattaaaatctgcttcgtacaatgatattcttccaaaatatcagaaaagattcttaatattcttatgtcatcgagagggtctaactgatgaagtaaatgacgatagcgaacaagtttatagaaatataaagcaagtcttaaacaacttccaaagcaaaaaatgatcacaaggattgtcagaaattccacagataaaatcttcacccttaaaagatcaaaaagaaaaggaagaattttatgggattcaacatttgctgcaaaatgaaaattccaaggcaaaagcatacggatcgtgacaactccgacagcaagataaatcacaaaggttccgtttcttaagataaatcgtttgcttctgcaaaatacataaagataaagcatcatcagactgccaaaaagacagcaactaaatacggaaccataattcgcaggtgtcatatcaagacttcctttctagaattttcttacgttcctctaatttctcctgtaaacgttcgatcactttaatatcattttcagactccacatattgaagaagtatattagaagataaaagatctttcagcactccgttgatattctcagaagcataatcttcagaggaaacaacaggaatataacgtctggttaaaactttaccactatatacaatgtcggaaacttcaatatagtttttcttaagtagagaacgcaatgcagattgaacggaattcagattcagtgaaggatcaagttgaacaaaatcagaagcgatcataggctcttttttgtcccataatgttttcatgatatttaattgtgatggtgttagttttttgtatttcataaatcattaactccttgagtttattttatagcaatatatttatattttcaacaactattttaatttaaaaaaataaatgttttaaattaaaatagttgttgaaaaaagaatcataatatagtagaatagaaaacgaagataataaatattgatacatggtaggtggggtattattaaatttgtaataatacccctaaattttttgtcaagtaataggtcatattttcaataaaactctctatcatcaggttatctactaccaatataacacaaaacacggagaaatgaatagtctgatagaagaaagaaatacagggaaaataatatggcaggagtaattttagatgctggccacggcggttatgataatggagcccagtatgatggaagaaaggaaaaagacgacaatctaagactgacactcgcagtcggtcagattttagagcaaaatggtgttccagtatcctacacaagacaaagtgatatctaccagtcaccatctgaaaaagcaaggcttggaaatgaaagtggagctgattattttatctcatttcatagaaatgcaagtccaaatgcgaatgaatatcaaggcgttgaaacactggtatttgatgatcaggggatcaaagcagagatggcaagaaatgtaaatgcgaacttagaacaagtaggatttcgtaatattggagttaaagagcgcccgaatcttactgtattaagaagaacaaagattcctgcgatcttgatcgaggcaggttttttaaattcagatcaggacaacgaaagatttgatgagaaatttcaagagatcgcacaagcgatcgcagatggaattatggaaacgatcggagatgaaaatgaagctctgaagggaatctatcgtgtccagattggtttataccgtaatttttctaatgcacagtatgttctgaatcgtgcggttgcagatggatacgaggggaatatcgtttataaggatccttattatgcagttcagattggggaatataatacgcttgatgaagcagtaagattggaaaatgaattgaagaaaaaaggctatgatacacttgttatcaaggaatgatcttaatttaagaaaaacacacatactgcaaggtgcgcagccaatagagattgtaaaagatggcacgcaccggcagtaaaaaagtatcacaatatccattgtaaaaaatataaaaagaaaaagctaaaaaaggcttgacttttgtataaaatgctgataagataaaagcaacttaaatgatatgaatattgaggattgtcactggtaatgcaggcaaaaccggattttataagtgtgaaagtgttgactttcatatttataaaatgtggttttctttttgttttaaaatagaacatataatatatatactagaagaaaaatttccaatgatcatggagagaagattatgaaaatagataaggtaatgaacaacaacgtagtaagcagcatcgatgaagatggacaggaaatcattgttgttggaacaggaattggatttcaggggaaggaaggaaaagtagttgatgagaagaagattcagaagatctttcgattagaagacccgaagatgatccggaaattaaaagagatcttacaagatcttccgatggaacaatttgagatttcaacagcgatcatagaacatgcaaagcaaagtttaggaacagaattaaacgagaatatttatgtgacattaacagatcatattcattttgcgattcagcgatatgaagatcatatgaattttccaaacccgatgcttagggaagtaagattattttatgagaaagaatttgcacttggagaatacgcgttaggaatgatcaaacagcgattgaatatatcactcccattagatgatgcggcatccattgctttacacatcgtgagtgcagaatttgatacaagagtcaaagatactttaaagatcactgaatttttagaagatgttatggaacagataaagaactacttccatttggaaatcgatacccagtcattgagttatgaacggtttatcacacatttgaagtttttatccagaaagttatttgcgtcagaacgaatggatgatatgaacaatgatgtacaggagatgatccagaagatttgtccggaagaatatcagtgtgcaggatatattaagacttttattaaagaaagatacaaaaaagatatgacatcagcagaagttgcatatttaacgatgcatatcgagagaatcagaaaaagcagtatagaaaaaggagaagaagatgtttgattcattaaagaagatgtttgagaagaacgcaaagacaatttcattaaaagcagtagaagatgggagaacaatcccaatggacgaagtcaatgatcagacattcgctcaggaattattaggaccaggaatcgcaattgttccatccaatggaacagtcgtttctccgatcaatggaacgatcgccacggtaatggatacaaaacatgcagtctgtattcagggagaagacggattagagctgatcgttcatgcaggacttgataccgtggaattaaatggaaagtactatcagacatataaagaaattggagatcaggtaaaggcaggagacgttttgttggaatttgatcttgaagagattacaaaggcgggatatgacgtcacaacgccgatcgtaataacgaacttaggtgattataagatcacgaagtgtttgacaggacaacaagtaaaagcaggggaagaggtgatacaattaacaaaacaataacaaagatgagtaactaaaagagaaggaaaagaacatgaaaaacttaaagtaaaaatgaaaggggacaatctatatgaaatttttacaaaaattaggaaaagcgttaatgcttccagtagcatgcttgccaatctgtggtattttaatgggaatcggatatgcactgtgtcctgcaaccatgcagggtggtgatatcacaggtattggaaaccagatcggattcttccttgtaaaggcagggggagcattgatcgacaacatggcattactgtttgttatcggtgtcggtgttggtatggcagaaaaacatgatggaacgggtggcctggcagctttagcatcatggctgatgatcacaaatttgttatctacagcagtagtaacaacaatcatgccatctattgcaaagaatgcagatgcaacacttgcatttgataagatttccaatccgtttattggtatcttagccggtgtgatcggatctatgtgttataacaaattcaaagatactaaattaccagattggttatcattctttagtggtaaacgttgcgtagcaattatcgctggtgttgtatctatcattgtatcagttgtattactgtttgtatggccagttgtatttacagcattgatcacagttggtcagtctattgccaagatgggagctgttggagctggtatttatgcattcttaaaccgtctgttgatcccaacaggattacatcatgcattgaacaatgtattctggtttgacacgatcggactcggagatttaactcatttctgggcaggagaaacatctaagaatgtatcatggagccttggaatgtacatgtcaggattcttcccatgtatgatgttcggtattccaggagcagcattagcaatgatccagacagcaaagagtaacaagaaaaagattgccatcggtttagtaggatccgcagctctttgtgcatttgtctgtggtgtaacagaaccatttgaattcggatttatgttcttagcaccaggtttatatgttatctacgcaatcctttacggaatctttacaacgatcacaacactggtaggattcagagcaggatttagtttctcagcaggagcaactgaccttgtattctcatcttccttaccagcagcacagaagacatggatgatcattcctttaggaatcgcagcatttatcgtattctatgtagtattccgtatcgcgatcacgaaatttgatctgaaaacaccaggtcgtgaagatgacgatcttgatgaagaaaatattacattagccaatgatgattttacagcaatggcagcagtcatccttgaaggattaggcggaagtgccaatgttaagagtattgataattgcatcacaagacttcgtctggaaatcaatgatgataacaaaatagatgaagcgaagatcaaatcatcaggagcagcaggaatcattcgtccaggaaaaggtaacattcaggttatcattggaccaaaagttcagtttgttgcagatgagatggaaaaattatgtaaataagcctttattgttattcatagttttctccgaaaacgggccggtgatatgccggctcgttttgtgttgataattgacagtgacagaatggtcttgcaggagatgattattaacttgaaagtacattcaaaaatatgatcaaacaaaaatgcaccgtgaaggaagaatcagtttcagtaaaacagggcaaaaaagccctgttttatttgattgtatagtatcagactgctaaaatagaatcagaaagaacaatacaaatgggtaacggaaatcgaggtaatataatgattataaaaaatggactggtattcacaccagaaggaaaatttgagaaaaaagatctctatgtagaaggagaatacgtagcaaaagaaacaacggacaacaaagaagtagaagctgaaggatgttatgtgataccgggacttgtcgatattcattttcatggatgtgtcagacatgatatgtgtgatggaaccgaagaatccattcaggcactggctgattatgaagcagccaatggagtattggcaatctgtcctgcgacaatgacgattccagaagaagaactatttcaggcaatgaaggcagcaaaaggacataagaatggaaaaggtgcagatcttgtcggaatcaatatggaagggccttttataaacaaagagaaaaaaggtgcacagaaagaagaggacatcaagctggcagatgttgaattattccataaactgcaggaagcagccggtggattgatcaaattagtggatcttgctccagagactgaaggagctatggattttatcaatcaagtgaaagatgaagtacatgtatcaattgcacatacgatggctgattatgatacagcaagtgaagcaatcagaagaggtgccgatcatatcacacatttgtataatgctatgccgccgttaaatcatagagaaccgggggttattggagcagcaagagacagtgattgttatgtagaactgatctgcgatggagttcatattcacccatcctgtgtcagagcaacctttgaaatgtttacagacaagaggatcgtactgatcagtgacagtatgatggcaacgggaatggaagatggacagtatgaattaggcggacagccagtgactgtagtaggaaacgttgcaacactgaccgaaggaggagccatcgcaggttctgcaacaaacctaatggattgtatgagaacggtagtcaaagaaatgcatattccattcgaaagtgcagtccgatgtgcaactttgaatccagcaaaatccattggaattgatgataaatatggaagccttgaagaaggaaaatatgcgaatgcagtagttttagataaagatttaaatattgtatctatcattcagaaggggcaggtaaaataaggaatatcaattgagataagaaaaagaattctgtgtaggcaggattctttttttatacaggaattcataaaatgataaaaacaaagggagcagaaaaatgcttcgaaaaatcacgatcatgatctttctgatcttaacagtagtctggtttacaaatagtgacagtatccagcccgccagagaatttatacaaaacaacatttatgtctggagtgaaatgcaagaggaaaaacttccaatctattgtgtagatacgcagaaaaaacaaatagcactgacatttgatactgcatgggggaatgaagatataccacagattctcaaaatattaaaacaggaaaatgtaaaagcaacttttttcttctgtggagactggatcagcaaatatccagctgatatcaaaacaatctatgaggaaggacatgatattgcaagtcatggagatcatcataaatacatgacaaaattaacagacaaacagcagcaggaagaaattcaaggagtgacacagaagattcaaggattgttaggtatcaaaatagatcttttccgggcaccatatggagattataacgaatctgtcgtaaggaatgcaagaaaaatgaactattatatgatccaatggaacgtagacagcctagactggcaagagccaacgaaagaacagttaattaagaaagtttgcgaacacaaaaatttatcacctggaagtatcattctgatgcatacaggaacgaaatgtaccaaacaggcattaaaacagatcattaaaaatatcaaagcaaaaggatatgagtttgtaccagtgtcaagattgatctatcgaagagattaccgtattgatccaacagggaaacagatgaaactatgaaatatcaaagaggtatcgaaacaagcatcgaaatcctattaaaacactcgaaaatcttgacaatcaaataacaaataatacataataaaaagaaacgcataatttcatggtaatctgtatatgcagatcttaagccggaatacttgccatgatctaaggatatactttgcgagcgacgaagtcgtcctcatggtgccagaatgacaaaagataagatgataaaatgtagtctttttagaaatgaataagaatgcatgtctttttgttatgtaaataagccagagtagatccttttatgctgtatacgtgggaggatctattttttatgaaaaaatatatggtatggctgatttctgcattgatggcagtatcgatgacagcctgttcaaatgcacagaaaaaagatacaaaagatcaggcacagataacaacggcagcaaaagagaatgcaacgcagacagaagcagcaaagacaataagtaaaaaagagaagaacgaaaagaaaaaagataaaaagaaatcacagaagagtaagaaaaacagcaaaaagacaaaaaacagtacagcaaaaaagaaagagacaagcacaacaacagctaaaaagaaaaaagtaaagaagaaaaaaacaaaagaaaagacaacaaagacaaagaatacaaaagaaacaacaaaaacaacaacagccagtaaaaatgaatcaacagtacagacggcagagaatcagacaacagaagcaaaacaagaacaatcttgtgaatttctgatcagctgtaaaacagttctctctaataaaagtgcattgcaatccaattaccaagttccagctggcgggaaaatttatgagaagaagatggagtttgaagaaggcgataccgtgatggatgttctcaaaagaacaggagtagatattgatgtttctaaaggatatgtagcaggaattgacggtttatacgaatttgattgtggaaaaaacagtggatggatgtaccgtgtcaatggtaagtttccaaactatatggcagggaaatgtaagcttcatgatggggataaagtggaatggctgtatacctgtgtcagaggagatctgtagatgatcaaggcattaaaaagagcccatccgttcgttgtatttacttattttacaggaatgtttttgctggcaccatttagcagacatccatggatgacaggagtgcagatgatctgtttatgcctattgtacttttatcataatcggagtttgaaaaatttttttccgttgattgctttgatcttaatcgtggctgtaacaaatccattatttgtacaaagaggaagaacaatcctgtatgcagacacacacataaggatcacgaaagaagcattgctttatggaattcattacggatgtgtattagtaaatcttttattggtcttttcaatctttaaccaatatataaagaaagagcagtggatctatttatcaggcagattcttccctaaacttggtgtcgtaacatccatggcatttggattgatcccaagatatcaaaaccatgcaaagaagattttaaacacacgaaaatccttaaaatcagaacaggctgtacagcgtgtcatgaatacagtgtcaatggaaacgacatgggcatttgagtcttcgatggatcagttggattcaatgaatgcacgaggctatggagttaaaaaaagaacgcattttcatttatttacatgggagagaaaagactggattcatatagcggagattgttattttaatgacactgaatttatgggcatatactcattattattccagatttttcttttatccgatgatcattatgccagcatttcagatgagagatctgttgtggatgtttatgatggcatttcagtttttattaccatgcatgtggaaggagaattttgatgtacgaaattaataatttaacatttcgatatatgttatcggatagaaattctctagagcaagtatcattaaaaattaaaaaaggaaagatcactctgatcgcagggccaagcggcagtggaaagacgacgttgttaagacatttaaaaaaagaactgctgcccaaaggtaaaagatctggaaaagttttatatgatgggcaggaaatagaacaattgaaagacttgcagtctgtaaaagaagttgggtatttatttcagaatccatcagcccagatggtaatggataccgtatggcatgagatcgcatttggacttgagaatctcagaatgccttatgaacagatgaagcgaacagtagccgagattgttaattattttgatctgcagaaaatataccatgaagatacagacaagctatctggcggacaaaaacaattggtgaatctggcagcagttatggcaatgcatccgaaagtattgattttagatgagccaaccgcacagttggacccagcggcaaggaaagattttcttgtgatgcttcagaaaatacataaagaatttggtttaacgattattttaacatcgcataacttggaagatgtgatggaaatgtcagatgaatgtgtgatcttagatgatggaaaagttatcgaacagggaaatccgaaagaggttgcaagacatcttcaaaaaatacatcatccattggaacagtctctaccacagattcttcggctagaagagaaatttcagatagaactgaccttttcgatggaagaagcaagggaacagatcaggaaaaaagaatatcagttgataaagaaaacacattttgaaggaaaaacagttttttcaatttcacatttatatgcagggtatgagaaaggaaaggatgttctttcgaatctgtcagtcgaagttaaagaaggtgaaatctttgcagctgtcggagcaaatggaagtggaaaatcaacgcttctttcttgtatggtaaagcagatgaaatttgatggaaaattaaaatgcaagaaaaaaatcgtctatatgccacaagatccaacactattgtttgtaaaagatcagttgtttgaagaccttttggagatgggaaaagaaaaagaagtaaaaatcgataaattattggaaatggcggatctaatgagagaaaagaagtcacatccatatgatctaagtggaggacagcagcagatggcagcgttgatcaaagtattacttgcagatccagaaatcttgctgttagatgagccgaccaaaggaatggatcgggaacacagcaggaagtttggagaccttttacgcaaacttacagatcagggaaaaacgatatttatcgtatcgcatgatctggaattttgtgctgagtatgctgaccgcgttggaatgatgtttgatgggaaaattgagggaattgatgagccatccaagttttttgcacaaaattatttctatacgacagagtgtgcaaagattacgagagattttgagaaagtgatcattctgccacaggaggtggtaagcgtatgttaaatgcggtgatcatttttatggtgtgtatatcatgtattccatactattttaaatatgaaaagaagaaaccacagacaagagaaagtgtcgtgcttgcggtgatgatcgcattgacggttgcatccagaatgttatttgcattttcaccaggatttaaaccagttagtgcaatggtgatcatctgtggtatggcatttggaagagaatctggctttttatgtggatctttaagtgctgtggtatcgaacttcttttttggacaaggaccatggactccatttcagatgcttgcatggggaatgatcggatggatctcaggaattttaaatcagagaaaatggttggaaaacagtaagatactgttaacgatttttgggattctttcaggaatttcatattcttttgtcatggatatctggacacttctggcagcaggagatggatttcagtggatgcggtatgtggcagtattaggaacttcggttccagtgacgattgaatactgcgtatcgaatgtgatatttttatggattttaacacctgtttttgtaaagaaactaaacagggttaaatataaatatggtttcttcaaagatgaagaagtcaggaaactaatcaatcaatgagacacaacaaggaggaatttatgagaacgatgaaacgtgtagcggcagtggcattgtctgttgtcgtgctgatgacatcaggggttagtgcaaaagcagcagtgacggatgtgcagccagcgaagagtaaagaggaagctgtagaaaaatggacaaataaaatagtgccaagtgggcagtgggatacattgtctgacattaaggttgtaggaaattatatttatgcagcagatgatagtcaacatagagttgttaagcttgacaaaaagacagggaatatagtgaaagaacataaatattctaatgaagaatatacacaatatagtgcatcttatattggatatggcgacggaaaagtttatgttgagtataatggaagaattgaagcttttgatgaaacaacattagagcctgtatggattagtgaagagttaagtcatgaagaaacaaattctgaaacaggaaaaacaacaacagtggatgatacaattgcatcaagattgttttatgatgatggtcatttatattttggaacaggtaagaactctggcagtggaaaatattatgtgattgatacaaagagtgaaaagaaagaagatgctacaaagacagaagaaataaagaatgtaaaagaaattatatcatctgaaggaagtttctatttgaaaaatgcagtaaaagtaggacagtatattattacttcagataatcaaggaacaatttcaagtattgatacaaaaaataatgataaagtagtatctacaaaagaaattggaaagagatttagtggtggaattgcatatgataaaactactaatatgatttactttgttgcggggacaaatgatctttatggtgtaaaagtaggaaatgatggaacgtttggagaagaaaaaagcgtaagagtatatgaaacaggatattctgcaatgacacctgaagtatataatggaaaagtatatgttagtggatgtgtaggaacaagtccattttcagataaaggatatcttgcagttgttgatgtacaatcagaacagtataaagtaaattatattgtagaacttccagcatatgctatgggagaaatgttagtgtcaaagacaggagaaaattccgtgcgcttatactttacagtaaattatgctgaatcagatgaaaattatgttccatatagtggtggtggaatttattctattgaagatacaaaaggagcgacatcagcaaaattagaaacgatttatgagccagacaaagatcatgctaattattgtatgaattctatttatgtagatgaagatggaacaatgtattatatcaatgattccaaaacaatttttgccattggcaaaaaagcagcaagcataacaccatcaacatccaatgcaacaacaacagtagtcaacgaaacaaaagtaaaaccagtcacaaaaacagtaaaaagtacaagaagcgtaaaactgacatggaaaaagaaaaaatccgccaaaggctatgtcatttacgccaaagcaggaaaaggtaaatacaaaaaagtaacaaccgtaggaaagaaaacatcaaagacgatcaaagtcaacaaagactcatcctacaaatttaaagtaaaaccatacaaactaacaaagaaaaataaaaagaaatattttaaagcctatgcagccaaagccaaattcggaagcaagacagttaaagtaacatttaaaaatgtcacaggatatgcaagctacaaagtgcagatgaaagcaggaaaagcagcatataagacagtaaaaacaacaaccaaaggcggaacgatcacatatacaaagaaaaaagccaaagtaggaacaacttacaaattccgcttaaaaggaatcaataaggtaaacggaaaaacagtttctgtagtgatcaaatagaagtactggataaaatacaaaaaagggcttgattttcaaaaagaatcattgtatcctataaccagtgaagttactgacaagggcgtcaaacaattagtttcatattgtttgtcgcccctttttttctactatcagttagataatagaagaaaaatatatagattatgcttcaaatgtaagagaagaaaggaagaactctatgaaggaaaaaatcaatgtatcagaaatcttcggatcccacgtatttaacgacagtgttatgaaagcacgtcttccaaaggccgtttacaaagatctgaaaaagacaatcgaagaaggaacagaattaaatccagcaattgcagacgtagttgcgaatgagatgaaagaatgggctattgaaaagggtgctacacattatactcactggttccagccattaacaggtgtgacagcagagaaacatgacgctttcattaacccaacagacgatggtaaagttttacttgagttctcaggaaaagaactaatcaaaggtgaaccagatgcatcttcattcccatctggtggattaagagcaacatttgaagcaagaggatatacagcatgggattgtacatcaccagcattcatcaaagaaacagataatgcttgtatcttatgtattccaacagcattctgttcatacaaaggtgaagcattagacaagaagacaccacttcttcgttctatgcaggcattagatatccagacaacaagattattaaatgtattaggaaataagaatgtgaaacgtgttagcacatccgttggaccagaacaggaatatttcttagttgatgaagaaaaatataaacagagaaaagacttgatcttcactggacgtacattattcggagcaatgcctccaaaaggtcaggaaatggatgaccattattttggaatcatcaaaccaagaatcgaaggattcatgaaagatttaaatatcgaagcatggaaacttggaatcagtgcgaagacagaacataacgaagtagctccagcacagcacgaattagcaccaatctataactcaaacaacgtggcaacagaccacaaccagttattaatggaaacaatgagacgtgtagcaagacgtcatggattaaaatgcttacttcatgagaaaccatttgcaggaatcaatggatcaggaaaacataacaactggtctatggtaacaaatgaaggaaagaacctgttagatccaggaaaaactcctcatgaaaaccagcagttcttactgatcttagcatctattatcgcagcagtggataaacatgcagatttacttcgtatgtcagcttccacaccaggaaatgaccacagattaggagctaacgaggcacctccagcaatcatctctatcttccttggagatcagttagaagatgttgtaaaacagcttgtaacaagaggtgaggcgacagaatccaaacatggagacaaattagcatctggtgttcattcattaccagcatttgagaaagatgcaacagaccgtaacagaacatcaccattcgcatttacaggaaacaaattcgaattccgtatggtaggttctacacagtctatctctgatccaaacgttgtattaaatacaatcgtagcagatgtctttgcagatgtatgtgacagattagagaaagtagaaggcggagttgaagcagtagctatggaagctcacgagatcacaaaagaattattaacacagcatcagagagttatctttaatggtaacggatattctgacgaatgggtagctgaagctgagagaagaggacttccaaacttacacagcatggtagatgcaatcccaacattaacaacagataaagcagttaagatgtttgagaaatttggagtatacacaaaagaagaattagagtctcgtgttgaagtattatatgaacagtattctaatacaattaacattgaaggacttgcaacattagatatcgctaagaaacagattgttccagcagttatgaaataccagagaaaacttgcaaatggcgttgctgaattaaagacagttggtgttgacagctctgtacaggaaaaattgttagaagatatcacagcaaacttaaaagatctgtttgctgcgatcaacaagttagaagctgatattccagaagctcaggcattagaaagtgaagctcaggctcgctgctatcatgatacgattttcacagatatgagtgccgtacgtgaaccagcagacaaactggaaatgttagtagcaaaagaagactggccaatgccaagttacggagatctgattttcgaagtataataattacatagtttgtaaaacttcttaatacacaaagagaaagcagcagagaaatctgttgctttctttttgtgtatcaaccattgtttgaaaaatattccagaatatattttttgaaatttcatattctaaagaaaaagaatatcttacaaaattagaaaagaggaagaatatgaaaaagaaattttttgcatatatgatcatagggattcttctgttcacatttctggcacaagggaagggaacaaagacatactggtttcagattgcaagtcagggtgaaggggaaagtggctttttaactaacagtaatttgaatcaaaagaaagtttatttaacctttgatgatggaccatccgatcatacggcacagattcttgatattctaaagaaacataaggtgaaggcgacattctttgtcgtaggaaaagaaacggaacatgccaagaaaatgtatcaaagaatcgtgttagaaggtcatacattggcaatgcattcctacagtcataattatgatcagatttatgcgaatgtaggtgcattttcgaaagaccttatgaaactacagaaatatttatatgatctaacagatgtaaagccatatatttaccggtttccgggtggcagcagtaatcattgcgcaaaaaatataaaaccgtatatccggtatgtgaacaaaaagggattactttattttgactggaatgcattgaatgaagatgcggttaattttgaacaaagtcctcagcagttaaacaagaagattttaaaggatgtcaggagacagaaaacaagtattgtattaatgcatgaccttcatgagacaacaaatacagtgaaagcattagatccgctgatcaaaacattgaaaaaagaagggtatcagatccttccgatcactaaaaatactaagccgctccatcatgtatccattgacaaataatgggctttcacgtagaatatgttcggtaaaggatttattttatgtgaggagaatgacatgatcataaaaagtgtaaatttagaaactgtctgtgggatcacaagtaaattaccagacaatacattgccagaagtggcatttgctggaaaatcaaatgtaggaaaatcatcactgatcaatgcactgatgaaccgcaaatcttacgcgagaatttcagcacagcctggaaagacacagacgatcaattattacaatattaacgaagaactttattatgtagaccttccaggatatggatttgcgaaagtaacacaatccgtcaaggaaaaatggggacacatgatcgaaaattacttacagacatcaaaacagctaaaaatggtctttttactgatcgatatcagacataagccatcaaagaacgatgttatgatgtatgactggattcttcacaatggatatcgtccagtgatcattgcaacaaagcttgataaactaaagagaagccaggtgccaaaacatctaaaagagatccgcacagagcttcagatggataaggaaacaccaattttcccattctcagcattatcgaaacagggaagagatgagatctgggatttcattgagtcaatggtgcttcaacaagaagaagccgaataattatttattcggctcgtcaaataacaatttttcaattagcatagaatagacatcggagtgttttttctcccaatggtcacatatgtaaactgcctggtctcttgagacaacatttaagttgatctcaaggagcaggttttctttttctctgatcttaagatttacggtatattcgtctcctttggatggataaaaatcagcagtcacactggcttccttacgaagctcatattctttttcttttaaaaactgagcgatatcttctttgatagagtttggaatctggtattcaaacatctcaattgcttcagatccctcgtcactgagcgcgtagtggctcatattacgaatctgcttaactctgagcatattttcttcctctaactcatgaaaagctctctgaacagtaaaataattggtatatcccttatcaaggataaattcagaaatctgtgaattgctcaaagggaaatctaccttctcaattaaatataaaatcataagcttataaagtgttaattgttcttgttccatggctgatctcctttgatttatcgataaaagtcactatgaaaaattataacaccacatgatttttcttgcaacttatgaatgaaaagttaaaaatgacagataataacgctgaggtgataagaatgaaaagaaagtaccagtggatcctatgtgcaggactgatcatttttgtgatcgcagcgttttgtgtcttagtatccaaagataacaaggaagaagtgaaaggtgcatttgtaagagaaggaggatatcaaagtgaatgtttatatcaaagcgcaagaaagtgtatgtcttgtgcatccagagattaaaataaaggatatcatgtccctgtactgcaccgacaaggatttggaacagaaaataaagaatcaaagtgtttatcattttataggagatcatgatcagagaaaatgtttttctgttttgatgttagttgaagtgataaaacaggtggataagacattagatgtgattaatttaggtgccgaagattttattgtatattacaagagaaaacaagaagaatcaaagatttttcattatggaaagatagtctttgtaattttagtcgcattttttggtgcaagtttttcaattatgacatataacacggatgttgggatcgaagaattgttttataacgtttatgaaatgatcatgggacaggcaccagatggtccaaatattcttcatatttcttatgcggcaggattggcgattgggatcattctattttttgatcatgcaggtaagatcaagttaaatgatgatccaacaccatttgaagtacagatgaggctttacgagagagatgtgaatgatacattgatgatcaatgcagggcggaaaggggaagaagcagatgtggattcgtagtttctttctgatcttttacggattgtgtgcaggcggcttgatcgcagccagttttctggcatttttgagtatgttaggtgtgatcccgagattagcaggattgacgaagagtatgaaaaacgccagaatgtatgaaagttttgtggcacttggagggattcttgggacattggtctttctttatcgatggcagatcaaagctggatacccgcttcttgtactgtatggattgtttggaggaatctttgtgggatgtatgatcggagctttggcagaaacaatcaaaagtcttccgatcttttcaagaagattaaatttgagatcagggattccatatgtaatctatgggatcgcatttggaaaaatgctaggatgttggctttatttttatatattttcataaaatgaagaaagggtgatacaagtgaaaaaagaaccaagcaaagaagaatatcaacagatcgtgaaaaatcttacaccaaaacataatagtctgttaaattgcacaaaagcgtttgtaacgggtgggacattttgtgttcttggtgaagttatgaagcagttaatgatgaaatatttgaatctctccaagaaagattcattattatatgtgacaattgaattgatcttactaagtgtcttattaacaggatttaatttctatggaaaaattacaaaatttggcggtgcaggcgggcttgtgccgattacgggattcgcaaattcagtggcttcagctgcaatcgaatatcagaaagaaggacaggtttttggtattggcgttaagatttttacgatcgcaggaccagtgatcttatatggaatcttctcatcatttgttgctggattgatttatttattcacaaagcaatgggggtggtttctatgacatcaatttgtggtatgcagagtctaaagtttgagaatgctccgtacttaaaaggctgggcatcagttgcagggaagaaagaaggggaaggtcctctgggaaatctgatcgatcagatcattgaagatccatactttggacaagaaagctgggaattggcagaaggccgttttatgaaacaggcagcaatgcttgcgatcagtaaagctgatcttcataagaaggacatccgttacgcgtttgcgggtgatcttttggaacagaatacagcaacgttttctggaatgaaagaactagggataccgttgtttggactttttggagcatgttcaacggtaggagaagcgatgtctctggcagcgatgagcgttgcaggagggtttgcaaagcattcacttgcaattgcttccagtcatatcggaagtgctgaaaaacagttccgttttccgttagaatatggaaatcagagaccattatctgcgacatggactgtgacaggatctggaggttttattgtgtcaaaagaaattggtcctgtaaagattcaagggatcacaacaggaaagatcgttgattatgggatggaagatccgatgaatatgggggcttgcatggcgccagcagcggcagaagtaatctatcagcattttgtggattttgggtcgaagcctgaagattatgatgcagtatatacaggagatcttggagaagttggcaagaagattttgttgcatttgcttcgtgaaaatggatatgatctttcgaaagttcatggggattgtggaattgaaatctatgagaatgagacgcaggatactcattctgggggctctggctgtgcctgtagtgcagtggttcttgcatcgatgatcataccgaagctcattgatggaacgtggaagaaagtattgtttgtgccaacaggagcattaatgtcaaagacaagttttaatgaaggtgaaaatgttgcagggatcgcacatgcgatctttctggaaggagtaagataataatggaatatatcagggcgtttttagtaggaggcattatttgtatcctggtgcaaatattgatggatcatacgacattacagccgggaaggatcatggtactcttagttattgcaggtgttattcttggggcactggggatttataaaagaatcgaagagtttggaggatgtggtgcgaccgttccgttgtctggttttggattcagtttatggaaaggaatgaaagaggcagttgacaatcatgggtttctagggttattcgaaggaggattcacggcagcagcagtcggaacatcagcagcattgatcttttcttatctggcatctttgatctttcagccgaagatcaaaaaataaaggcaggagtatgaaataaagagaaaaaagggattctgatttgagagaatccctttttaatataaaaatatagaagattaacggttaatgtttcttgcagaaaacagattgatatttttttggaagcatataaggagtgtctgctgtttttccatgactgccctttttgcggacaatgtaaatttttctttgttttttgtttgcaggacaattctttgtggcgagtttatcgcttgttttacatacttcaactgcaacgtggatatcacaggtctgggtaggaacggttcctttttcaaaatattctgtgatcacacggctgcctcttggatcgtgatcacaaacccctttaatagcaagttttccagactctttgcagacttttgcttttacaatgtcagctggttttttaaaatctgtagtttgttcttgttttgtttttatgatttcattcataacctttgcccatatttttttatgagtgttatcagaagcaaaatttgtattcttgtcatagcccatccagacagaagctgtatgataaggagtataaccgctgaaccagtaatcgtaactgtttgaagtagttcctgattttcctgcgacagccatagatgaagaaagttttgctgattttccagttccttttgtaataacgtctttcatagcgtcggttaaaaggaaagcagtactttctttcatgacacgcttacctttctgagtattagaaagaagaatattaccattatgatctacgacttttgtgtataaaacaggtttctggtaggttccgccatttgcaatggaagcatatgcagaagtcaattccatatttgtaacaccataagtcaggccaccaagagataaggactgggtaatatcggtatatacatttccatttgaagttgtctcattagacaccaaagtggaaaaaccaagattcatcaaatattcaaacgaagtcttaggtgtaacgtcagcaatggttttggccgaaacaacgttcatggagtttgtgatcgcttcgcggatcgttgaataacctttataacctttgtaatagttgcgtactggtctgttagtgtcaatatagttataaggagcatcctcatatacggttgcaagtgtcatatgattcttgtcaagtgcaggtaaaaatgcagaaagaatcttaaaagtagaacctggttgtcttgtggtaccagtagcacgattcaaggaaagatcggaagtcttatttccacgtccaccaactaaggcttctacagttccgttagattgattcatgatcgtcatggatatctgaggttggatcgttgtttggaaagattcatttgtaatggtttcaccttttgataaaatatattgtttaaactttgtaacaactgtctttgcatttgcttcatctgtaaaaatcaactgatttccaaggttattttttctcatataatcaagcagattgtgatcagaataaacaacgtcttttcctgaaacagtttttgcagataaagaataagaaagtgcgatttttgtggcttttggatagcttgaaacatcgtttgtgacgctatctgcaagtttctggatctgttgatcctgagtagagtatattttcaatccgccactgtaaatagcattataagcttttgtttcgtcataccccagttgcttttttaaatcttttacaacttgaaggattaatgcgtcctcaaaataagaatttgttgttttttttgcaggtgtagcagcagcatttttttgaattcttgtgtatacatcatcactaagtgcttctcgatattctttttttgtgatataatgttgttctaacatattttgtaaaacaagtgatcttctggaagcgttgttttccggatgagttacaggatttaaacgtgtcggattcttagtaatacttgcaagtacagcacattcggacaatgtgagttcagaaacatctttattaaaatatttttgtgatgctgtctgaacaccaagtgttccttctccaagattgatcgcatttagatattcttctaagatatattgcttagaagcaatcttttctagttcaagagcaagagattgttctttgatctttcgttccagacgttccattgtggttttttccggctgaattccaagtacattgttcttgatcaactgttgtgtgatagtacttcccccttggcttagagattggtttctgataccaaggaaggttgctcgaataattccatacagatcaattccattatggctgtaataacgttcatcttcaatcgcaataaaagcatgctgaagattctttggaatggaagaaagaggagtgtagatcctgttggaatcatggtttgaaagtgttttgatcgttgatcctttgttatcataaatagttgtgatatatcctttggaatggacggaatcttttgtaatctgtggggttgtttttaaaatcccacgtacgaaaccaaccccgaggccgagcccagtaacgatcaaggcaatggagatgataaaagcatatttaaaaagaaagagagaaatcttagaatttctacgaattttttctgaagataagatctgtctctttttctgaatgttttgtttggtatatttcataaaaaacctcctgttacgtattataccaaataaaaaagttcaagtaaaccgaccgtgtaactataaacgatacaatcaacaatatgatgatgtaaggggcaaaagtataaagtataaaggagaagaatatgaaaaaacaattaaaggggaagcagtcattttatgatgacaaacaaagggaaaatgtagtatcctactatttgatggaagatcaggaacacacgatgtatggagtcgaactggaaaaatatcaggaagaaacgaatgtgatcgagtgggatgcagttccaagtatatcagaatctatggaattagtagatcgtgtgatccataatctgataaaatataaagtaacaccgatctcactggcagagtccttagatgagatcatgaccagggaggaagaagatggacgttcaaaaatataaaatcttatataaagagggagaagcagagatttcagaaaagaaatcaagatttattgcacatattgctccagcgcagacagaagaagaagcacaggcattcatagagaagataaaaaaacaatactgggatgcaaggcataactgctgggcatacagtatcggagaaaagcaaccagccttgcgttgtagtgatgatggggaaccaagtggaactgctgggaagccaatgcttgaggtgctgacagggcaggaactacataatgtggtagcagttgtaacaagatattttggtggaacacttcttggaacgggaggattgatccgtgcgtacacaaaaagtacgcaagaagggatcaaggaaagtatggtgatcgagaaatgtcttggggtaatgctcagcctcacttgtgattacacgacatctggaaagattcagtatttaacagcaacagagcatatcccagtgcttgatacagtgtatacggataatgtaacatttgaaatgatcgtaccagtggaagaagttggaagtgttgagaaaaagtttatggaagcatctatggggaaagcagttcttaaaaaaggagaagaaacttattacgctgaaatcgatggtaagatcagttacgatctatagacgaagaatgatatgatttcattcctttacagtgataaaatatcatgttaaaatttatcatagttaattagtcagaaataatgaaaaggagcaaaattctatgaaaatatcagaaattttaaaaaataagtcaacaatttcgtttgaggtatttcctccaaagaataaagaaggaaatatttcttctatttatagtacgattgagggattagcaaaattatccccggattttattagtgttacatatggtgcaggtggatctacaaaaggtaagacagtagaaatcgcatcagtcattaagcatgaatatggaattgaatctgtagcacatttaagctgtatttcatctacaaaagaggatatcaaatacgaatgtgaacgtctgaaagaagcaggaatcgataatatcttagcattaaggggagattatcctgcagatgcaacaaactttgatcctgagaatctggaatttcactatgcaagtgaattaaatgaatttatcggagaacattttaaaggacaattttgcttatcaggagcatgttatccagagacacatcaggaagctgatgggtttaagaaagatttagaagcattaaagaagaaagtagatgcaggagcagaatatttagtaacacagattttctttgacaatgattattattacagattagtcagagaagcaagaaagatcggtatcacagtaccaattcttgcaggaatcatgccaattacgaatgcgaaatctctgatccgtacaacaaagatgtgtggatgtacgatcccatatcagttatctacaatgatcgaggcacattatgataatccagaagctatgaaagaaatcggaatcaactacgcagcacaacagatcattgatctgatcacaaatggagttgatgggattcatatttacacaatgaatcgtgcagaaacagcgcagcgtgtatttgacagtattccagctgtattgaaagaattaaactaagatggattttcaggttgtaagagaaaatgccttgaaatatcttggatatcaggcaccaatgtttgaaggtttgactctagggatttcaagtcttttgggtgaatgtatagaagagatcgaacagatagcacagcccaaagtgatagtgaaaagatttaaactggcgaaagatccattgagattagaggaatcaggggatgagattttagggcagcagatggaagatatgctggaagattgtgaagaatgtatattgatcggatgcactcttgggattgttatggagcgtaaaatcaagttttatgcaaaggttaacatgacaaaatctacggttatggatgctgcggcaagtgcttatctggaagaatattgtgacagatatgaagaaacacttgggtttgataaccgaacatatcgtgcatgtcccggatatggagattttccacttgaattcaacaaaagaattgctatattactagatataccaaggaagatcggagtcacgatcacgccaaataatcttttgatcccacagaagtctatgttaggattgattggtatcggaagtgataaacgaaagaaatcatgtggaaattgtgtgatgaaagaagattgcccgtttagaaagagaggacaaagatgttacagaaccgattaggaaaagaacttttaatatttgatggagcgatgggaacacagctccagaacgcaggattaagtgcaggggatatcccagaagaattaaatattgaccgcccggatttattaagatcgattcataaaaactatctgaaagcgggagcagactttattacaacaaatacatttgggtgtaaccgattaaagatggaagaagcaaaatacgaggcgaaagatatgctgttagcagcagtagagaatgcaagagtagcaagaacagaagctggaagagaagatgactcttatattgttcttgatattggaccaatcggtcagctgttagagccaatgggaacattgacattcgatgaagcatatgacatcatcctcgagcaggtagaaacagtaaaagatcaagtagatcttgtactgtttgagacaatgagtgatctatatgaggtgaaagctggagttctggcggtcaaagaacacacagaccttccagtgtttgttacaatgaccttcgagcaaaatggaagaacattatctggaaatgatccggaaacatttattaatgttgcagagggcttaggagttgatgcattgggagtcaattgttctttaggacccgatgaattaaaaccgatcattgacgaaatcttagaaaaagcaagtattccagtgatgttacagcccaatgccggacttccatgtttagaacatggagaaacacactatcatgtgacaccagaagaatatgtggaatctatgaaagattatatggcaagaggtgcagcaatcgttggtggatgctgtggaacaacaccagaatttataggaaaacttgcagaagctgcgcctaaagcagtggcagagagaacagttgagaagaaaacaagagtatccagtcagacacagacagttacgtttggagatcatgtgatcgtctgcggagaacgtctaaacccaacgggtaagaaaaagatgaaaaaagcgttgttagaagagcgctatgatgaacttgtggtggaagcagttaaacaggtagaagctggagcggaagtactagatgttaatgttggacttcctggaattgacgagccagagacaatgaaacgggttgtacgtctgttgcaggaagttgtcacacttccattacagattgacagttccgaagcagatgcgattgagaatgcctgtcgttattataatggaaaaacattgatcaactctgtaaatggtaaagacgaagtcatggaaaaaatcttcccaattgctaagaaatatggaggagttgtgatcggactgactctggaagacggaattccgctgaaagcagaagaacgatttgaaatcgccaagaagattgtcaataaagcagctgaatacggaatcggtaaagagaatatcatcatcgactgtctgacattaacagcatctgcacagcaaaaagaagtaaaagaaacactccgagcgatcaagatggtaaaaaaagaattaggtgtccataccgtattaggggtatcgaatgtatcctttggattgccaaaccgtccgttattaaatagaacatttttagcattagcaatggaagcaggattggatttaccgatcatcaatccgttagatgcagaattgatgggaactatagatgcatttcatgtgctgttctacaaagacgtggatagtcagacttatattaaaaaccagtccaaagataaagaaacaaaaccagccgcagcggcggcaacaacaaacttcacattaaaagatgtgatcattcacggattaaaagatgaagtagagaaagtcacaaaagaagaactgaaagataaagaagcactgacagtaattaatgaagtgatcataccagcgttaaatatcgtaggaaaagactatgagacaggaaagatcttcctgccacagttaattcagtcagcagagacaacgaagaaagcatttgaagttgttaaagaaacattttcagcaaatgatggagaagaaaaaggaccgatcatcatagcaaccgtagaaggtgatattcatgatattggaaagaacatcgtgaaagttgtactggaaagttatggatataagatcatcgaccttggaaaagacgttaaagttgaaaaggtagtagaagcttataagaaatacaagccaaaagcgattgggctaagtgcattaatgacaacaactgttgcatcaatggaaagaacgatcaaagcacttcacgaagcaggatgcagtgaaccaatctgggttgggggagctgttgtgacggaagatatcgcacacaatatcggagcagattattatacagaagatgcgatggcagcggtgaatctgctggaaaatgaaattttagatttgtagttggccaactttagattttgagtatatgagaaaaaataaataaacgatcggaagaacagctagagaattttcctcacgttttttacagatcgctgatccgccggctttccttgcgaactcgccttcaaagatatttaaaccagaactctttgaggctcagacagcgcaccaagccggctgcgaatctgtaaaaaacgtggcaaaattctaatgctgttcttctgatcgtttatttattttttctcatataccagaagtctaaagtgtggacaattacaagaattgaaaaatttaagtggtgtgtatgttgaatgtagtggtttcaataactgaaattattgaatattataaaaatggttatatgtcggcgaccgtaggaacacgcctgcacttagcgagtggatgatcgtaagatcattcaggagcttagtacagctgcgtagtgagtcgagcgagagcgcgttgcagacatataaccatttttataatattccaccaataatttcagttatttaaatcaaaatctactgatctaatcggtttacagcgctgatcagtgctaatacagaagcagtaatgatgtcttcgtggattccggatccccaagtaacattaccatttggttcttgaactccaacataagcacaagcctgagagttagaaccaacatttaaagcgtgttcctgataagtaacgatagagtaatgcatatcactgtgtctctgtaaagcgttacttacagcatccagacgaccatttccttttccgtggtaaagttttggaacaccagatttctctaaagagatttctgcttcgatgccaccgtctttctgtacgaagtgcacttcttttaatttgcatggatcatcaatatttacgtaaacttctttgaatacttttaagatatctcttggaactaattcctgatggcgtttatcagatacatctttgactgtgtatcctacatcttcacgcatttttccaggaatatggaatccaaagttttcttctagtacatagctgataccgcctttaccagactgactgttgatacggataacatcactttcgtattcacgtccaacatcgtgtggatcgattggaagatatgggatattccagtgctctggatgtttttcgtctctccagtgcatacctttggcaatcgcatcctgatgagatccggagaatgcagcaaataccagctgtcctgtgtatggttgacgttcgtaaacggacattcttgttaatctttcatagacttttgtaagttctggtaagttagagaagtccagttttggatcaacaccgtgtgtatacatatttaatgcaagagtgataatgtcaacgttacctgtacgttcaccatttccaaataaagtaccctcgacacgatcagcacctgcaagcaaggcaagttctgtatcagcaacaccgcatccacggtcattatgtggatgaagagataaaactacgttttcacggtatttcatatgtttgctcatatattcgatctggctggcatatacgtgaggcattgaaagctgtacagttacaggaagattgatgatgaccttccagtctggacgaggctgccatacgtcaagaacggcattacatacatctaatgcatagtcgatctctgtaccggtaaaactctctggagagtattcaaataagaagttaccgtctgtctcatcagctaggcgttttaataattttgcaccgtctgttgcaattttcatgatctcttctttggattttttaaatacctgttcacgctgtgcaacagaagtagagttgtatacatgaacgatcgctctttttgcgccttttaaagcttcgaaagtctttttaatgatatgttctcttgcctgtgttaaaacctgaatggtaacatcatcagggatcagatcattttcaatcaaagtacgtaaaaatgtatattctgtttctgaagcagcagggaaaccaacttcaatctctttgaaaccaacctttactaaaagtttaaaaaattcaactttttcatcaagactcatcggaatgatcagagcctgatttccatcacgaaggtcaacactacaccatgtaggtgcctttgtgatatattctttctttgtccagtcaagggacgtttcaggtggcataaaatattgtctttcatatttgcttgggttcatcattgctgtgaagctcctttcaaaaattaatgattgttgtaggtatgttttaagtattgaaaggtggatacggggtatcatgtatcggatgaaataaatgtacgataacataaaaaaaactccgaatctgatccttatcaggatagagacgaagaaacttccgcggtaccactctaattcacgttataaagaaacgtgcacttcttactgatacgggttataaaaccgatatctctccattataacggttggactccggcaatacctactgtaagttcagcatgctactcaaaggcgagttcaaatatcatcaacaattgcttcgcaccatccagcaactctctgaatgtcttaaatattctactattccttatcattgtatttaaatcatttacaataatgacaatctaacataaaaatcaggaagtgtcaactgataaaatgtaaaatataaagagaactttctttacagagaagactttcatatggaaacaaattatgataaagtagaacagagcaatggaggaaagagcatgagattttttgaatatttaaaaaaacaggaaccttcaaaagaaaatgaagaagcaagaaaacgaatttataagctgcatcaattagaaggaagccttacttatattgaacgaatggaaatcatcgaagaagggaaaggctccatggaagttgagtttgtcagaggagagttgagtgagggaatgacactttgcttttatgataatcaaggaaaagaatctggaagaggagagattctcgaaatttatattggaaagggagaagataaagggagattctcagaacaagggaataaggggaaaatcatatttgaatattggcagccagtaacggaccgtttctggaacagtcaatatctgaaagaattcactcttgaaaaataaatttaaaaaaattcaaaaaaagtgttgacagttgtcggaaacatatgataatataaacgagctgtcgcattgatggggtatcgccaagtggtaaggcacaggattctgactcctgcaccgctggttcgagtccagctaccccagtttaagggtgtgtagctcaggtggtagagcacttgacttttaatcaagttgtccggggttcgaatccccgcacgctcactatattttttaaaataaattttaaaaaatataaaaaagttcttgacaaagaacgacagattatatataatgaaatagttgtcgcactgatggggtatcgccaagtggtaaggcacaggattctgactcctgcaccgctggttcgagtccagctaccccagttaagggtgtgtagctcaggtggtagagcacttgacttttaatcaagttgtccggggttcgaatccccgcacgctcagttgataagcatgatttaagaatgaacttagatcatgctttttttcttttactaaataaaattcacaaaataaaagaagcctctaaaaacagagacttcaaatgctcgcattgatcacaagtaaacttatttttttaagtatggtgcaattgcagagctgatttcttcaagttcatctttaccatgtacggttaaagtcaaaggtcttgtcagatcaaggctgaaaattcccatgatcgattttgcatttacgatatatcttccagaagaaagatcaatctcagatttaaaatgtgcgatcgtatttgcaaatgcattcacgtctgcaatggaatcaagagaaataataaagttggtatccatgtttaaacctccttaatggttaaatctcttttatcctacaatttttttgatagaaagtcaaattcgatagataacagaaaagaagtatgataaaatataagacaacggagggaaaaagatgacggaaaaacaaaaaatgttgatgggaattttatataatgcagaggatcaagctctgatagaagagaggaaccatgcaaaatctctaaccaggcagtttaatgaacattgggaagataaaggacgtcggaattatctgataggacagatatttggaagtcttgggaagaatgttcatctggaagcacccatttatctggattatggatataggacaacgattggaagtgactttttctcaaactttaatctgacgattttagatggtggaggagttgaaatcgggaatcatgtttttataggtccgaatgtaggaatttatactgcgaaccacccagcagatgtgaagagacgagaaaagggatatgaatgggccctcccagttaagattggagataaagtatggattggcggaggggttacgattcttcctggagttacgatcggcgacaatagtgtgatcggtgcaggaagtgttgtaacaaaggatattccagccaatgtagttgctgcaggtaatccatgcaggatcatcaaagaagcggaagaaggagacagatatgggattattgacgagaaaaacggacagcaatccattaagtaagaatattgacgaattacttgatggaatgaatcaggagagggaagagacaaaagaaggaacttatgaagaatctttaaagaagattgaggagcggatcaaagaacttgggattttagaagaagagaacgaagattaagaaaggcatcggtggtgcctttcagactgtagacaaagtcccggtatttgccgggacttttactatgagcactgtttttctggtataataaaattatcagaaaggcggtgttttttatgatgacgaaaaatgcagacaagaaacgagaacagatgatgatgttctcaatggattccatggttccgcaggatcatatgctaagattgattgataaagcaatcaactggaactttatttacgatcttgtagaagataaatattgtcaaaacaatggtcgtccaagtatggatcctgttatgctcattaaaattccatttattcaatatctttatggaatcaaaagtatgcgtcagacgatccgagagattgaagtaaatgttgcctaccgttggtttcttggtctggatatgctggatcctgtaccgcatttttcaacgtttggaaagaattattcccgccgatttaaagacacggatctttttgaacagatattttcaaagattctggaagaatgtatgaagtataagttgatcaatacggacgagatctttgttgatgcaactcatgtaaaagcatgtgccaacagtaaaaaaatgcgaaaaagagttgctcatgaacaggcactctggtatgaagatgaattacaaaaagagatcaatgaagaccgacaggcacatgggaaaaaacctctaaaagataaaaataagaagaatccgccaacacctcccacatctaggaatgatcaacataatgagcttgaacagataccagacgatataaaaaccaaaaagagcagtattacagatccagaaagcggatggtttcgcaaaggagaacataaacatgtttttgcatatgcagtagaaacggcatgtgatgaacacggatgggtccttggatatagtgttcatcctggaaatgaacatgacagccgaacatttcaaacaatctatgaaaaggtgaaaagttttgaaccagaaatgatcgtggcagatgcaggatacaagacaccagcgattgccagacaacttctgaaagataggattgaaccattgtttccatataaacgacctatgacaaaaaagggattttttaagaaatatgaatatgtttatgatgaatactatgattgttacatctgtccagaaaatcagattctaagatacagtacaacaaacagggatggatacagagaatataaaagctgtggatatcaatgtgaaaaatgtccacagatatccaaatgtacagaaagcaagaatcatgtaaaagtgataacacgtcatgtttgggaaaaatatatagaaaaagcagaagatatccgacatgtaagagggaataaagcaatctatcagaaacgaaaagaaacgatagaaagaatctttggaacagcaaaagaacaccatggatttcgatatacacaatacataggaaaagcacggatggaaatgaaagccgggcttacttttgcatgtatgaatctaaaaaaactggcaagatttcttggtaagaacggattgctaaatggacaaaagcgaagatttctaagaaatttttggatacaatttaactttaaagggaaaaatggtgctgggatgatcccagcacctagtttgtctacagtctgaaaggcatcggtggtgcctttctttttttagaatgatcaaaagacccctttattgttaacttttaaaaaaacaaagttgacaataagggattgatgatatataatggcagtcagtacaggaaaataataaaagtgagggagaaatttattatggaacaacaaacaatgaaaattcaggatttaacactgattgcattaatggcagcattaacttgtattttaggaccaatgtcgatcacattgccatttacaccagtaccgatttcatttacgaacttggtgatttattttgcagtaatggttattgggatgaaacgtggaacgatcagttatcttgtataccttctgatcggagcagtaggacttccagtattttcaggatttagtggtgggcttgctaaacttgcaggaccaacaggaggatatttggttggatttatctttttggcattgatcagtggattctttgtagaaaaattctcagggaacatagtgatggcagtaattggtatggtacttggaacagcagtaacatatgcatttggaacaatctggctgtgtgcacagatgcatttaacatttgtacagggattatatgcaggtgtgattccatatcttccaggagatgcggcaaagattgtgatcgcgatcattgtaggaagtgcagtgaagaaggctgttgtgaaggcgagagttttaccagaataaataacaaatactttgtatgaaaaataagaatctgttgacattttgtatgaaaaagcataaactattcgtagttaaatgcaatgaacagaattagtacagacaagttggaactgtcagagagaagctgccatcggctggaagcggctttgagggaagatgtctggaatgcatctgggagcagacaagatgaataaagtagttttgtacgttgccggcgttaacggattcgagtgaaagtatcctgatcaagtgatattagtcagatatataataagaagatcaggaacttttaaaagagtggaaccgcggatatactccgtctctttatttagagacggagttttttgtattatagaaaattttgatggaatcctctatgatataaaaagtcctgtaaattacatactatatattggaggtttagaaattatgatgggttttcgagaatttgcgaaaagccaatatgatacgatcaaactaagagaccctgcgttaagggaagagaaagaagtttttttgtatccttatgtaaaagcactgtattggcatcgtgttgcacacgaattatataagaaaggagagttttacaaagctagaaagatttctcagaaatgggcgagaaaaactggaattgagattcatccaggtgcacagatcggagaagggttctttattgaccatgggcatggagtggtcattggcgagacgacgatcatcggaaataatgtgaccttatatcaaggtgttacattaggtggaactggaaatgaaactggaaaacgtcatccaacgatcgaagataatgttatgatcagttcaggtgctaaggttttgggatctattacaattggaaagaactcaaagattggtgcaggaagtgttgttgtatctgatgtaccgccgaattctactgttgtcggagttccaggtaaggtagttaaacaggatggagagagagtcaatcgcattcagagtattgtgcttgaccagatcgatcttccaaatccagtcgatatggatatcgaaaagctcgcaagagagaatgctgaattacgacaggcactggaaacatttattatacattatcaaaattcagaagcaatcagaagggaaaaagaaaaatgaaaatctacaatacactgacaagacaaaaagaagaatttgtaccggtgcatccagggaaagttggaatgtatgtttgtgggccaacggtgtataactacattcatattggaaatgcaagaccaatgatcatttttgatacggtgcgtcgttactttgaatataaaggatatgaagtaaattatgtttcaaacttcacagatgtcgatgacaagatcattaagaaggcaaatgaagaaggtgtaacagcaacagagatcgcagaaagatatattaaggaatgcaaacaagatatggaagcgttaaatatcaaacctgcaacccaccagccaagagcgacagaagaaatcggtggaatgatcaaaatgattcagacattgatcaaaaaagggcatgcatatgaagtagatggaactgtatactttaagacaagatcttttaaagattatggaaaactctccaagaaaaatattgatgatctagaagcaggacatcgcgagatcaaggtaacaggagaagaaggaaaggaagatcctcttgattttgtattatggaaaccaaagaaagaaggagaaatcgcatgggattctccatggggagaaggaagaccaggatggcatattgagtgttctgagatgtctaagaaatatatcggagatacaattgatattcatgcaggtggagaagacttgatcttccctcatcatgaaaatgagatcgcacagagtgaagcatgcaatggggagaagtttgcgaattactggatgcataatggtttcttaaatatcaacaataagaaaatgtctaaatcagcgggaaacttctttacagtgcgtgaaattggagaaaagtatccattacaggtgattcgtttcttcatgttaagtgcacactacagaaccccattaaacttcagtgatactttagtagaaagtgcaaaaacaggattagaccgtatcttgacagcaattgatctatgcagagagatggcagctaaagaagaaacaggttctttaagcaaagaagaaacagaacattttgctaatatagaagtacttgtaaagaaatttgaagatgcaatggaagatgactttaacacagcagatgcagtttcggctatttttgaaatcgtgcgtgaatcaaactcaacagtgaaagacttcagtgcagactatgcaaagaaaatactaaaagtattagaagatctttgcagcgttcttggaattgaaacaacaaaagaagaagagatcctagatgaagaaatcgaaaaactgatcgaagaacgtcaggcggcaagaaagaacaaagattttgcaagagcagacgagatcagagaccagttattagagcagggtatcgtattaaaagatacaagagaaggtgtaaaatggagcagagcttaattcaaaagatcaaagaaggattgtatcttgatggattggatcccaaaagttactctccattatctcttgcttacattggagatgcgatctatgagatcgtgatccgaacgatcgttatgtctgcagggaatatgagtgtgaataagtatcacaaaaaatcaagcagtatggtcaaagcttctgcacaaaaagaagtgtttgaaaagatcgagccatttttgacagaagaagaaatggctgtttataaacgtggaagaaattccaaatcaggttctgttgcaaagaatgcatctatgatggattacagaaaagcaactggagtggaagctttggttggatatttatatctggcaggagatatggaccgcatcatcgaattgatcgggatcggttttgatttgaataaaaaagaagaaataggagaagaacatgaatcataaagaagatctgatcgcagggcgtaatgccgtgatcgaggctttaagagcaaagaaaccaatcgacaagatttttgtattggatggatgtcaggatggaccgatccgtacgatcgtaagagaggcaaagaaaacagatgcgattcttaaatttgtagataaagaacgcttgaatcagctgacaaatgaacatcatcagggagttgttgcaattgtcgcagcatatgaatatggaacgattgaggatctgtttaaaagagcagaagaaaagggtgaggatcctttctttattctgttagatgggattgaagaccctcataatcttggggcaatcattcgtacagcaaatcttgcaggtgcacatggagtgatcattccaaagcatcgtgcagttggaattacaccaaccgtagcaaaaacatctgcaggtgcgatcaattatacaccagttgtgaaagtaacaaatattggaaaaacaatggatgaattaaaagaacgtggtatgtggtttgcatgtgcagatatggatggagaagtgatttatcgtcagaatctgacaggatcgatcgggcttgttattggaaatgaaggaagcggtgtgagccgtttggtaaaggaaaagtgtgactttatctcatctattccaatgaaaggagatattgattcactgaatgcttctgtagcagcaggtgttctggcgtttgaagttgtaagacaacgactgggaaaataaagaatgaaagaattaaaaacaatttctgatgagaaattgctcagacagatccaaagcggtaatgatgatgcgatggaatgtctgttagagagatacagggatatggtaaggaaagaggcaaggagcttttttcttgcaggtggggatgaagaagatctgatccaggaaggaatgatcgggctttttaaagcagtgacatcctatcaggaagaaaaaaacacttcgttttcaacgtttgcttatctgtgtgtgcaaagacagatctatacaacgatcactgcatttaacagaaaaaaacatattccgttgaatacagcaatctctctgtttgaacaaaagaatcaggaagaagaattatcattggatgagatcttagaaactccggaggaaactccggaggagatgatgcttcgaaaggaagaattaaatgattattacaaaatgcttgaccagaatttaagtaaattcgaaaaacaggtgatgtatcattatctgaatggagaaacatatacaacgattgcaaaaaaacttggaaaaagtgataaatccattgataatgcgattcagaggattcgcaggaagatcagaaatgatcaggaaagttaaagtaaagataagagaaataaaaagaagacttaaaacagatgttttaagtcttctttataaagctgctgacgggagttgaacccgtgacctcctcactaccaatgaggtgcgctacctcctgtgccacagcagcagaactgattaataatttatcatgaaaatgatatactgtcaatagaattaacaaaataaaaggaaaatcaaatgacaaaacaatacaggaaaaataagagaagaatctgtgtagtgatatgccttgttctttgcatgatctcaggcatcaaaatacaggcagcacagccaggatattttgataatccccagacggtctatgatgaatttgctgggaagatttatgatcgttcattcaaaaagagttatgcatttttgaaaaaaaagatgaatgtttttgaaacatcttcaggaagtaaaaagataggggtagcgccaagatattcaggagtgatcgtggttagtaaaacatccgatcatgttcaggtgatctatgagaaaaagaaagcatatggaattggatggattgatagaggtttgtatcataaggaagctattccatataatgggaatgaaaaacagttgctaggaaatggaacttattggatacaaaataaagcttctggagaaggaattcgtgtacagatcatttttctgggaaatcagaaatatcaagtttcgattttgaatcaaagcaaagaagatcacacatggaaactaatacgtgagtacgatcatttttatatcaaaaatataaaaaatgaaaaatatctgtcaatggatgaaaatggtaccttgacagacggtaaaataaaagatatgaacaactgtttcacaaaaccacagaaagaagcggcacagaagtcttatcaatggcaggtaatgcgtcttaacaataaaaatgtatatccgtatcgtgattttatgcagtttgatcctgcatgggccagaaaagattatggaaatgtttcggattacagtgggaaaatggcagcagcaggctgcggagttgtggcgatcacaaatgcagtatatgcattgaatgggcaatttgttgatccaatgttgtttgcagattatgcagtggagaaacattacaggatcataggtgccggaacacatgatgggatttttaaggcggcagcgaagaaatttggagacacatatgggttcacttatattaagacaacttacagtacatcagaagtaagagaatatctgaaaaaaggttgtgtagcaatctcgcatgtaccaggacattatgtaacagttgctgattttaatcccaagacaaaaaaatatctggtcttagattctcatccgatcaagagcagaccaaccagctcttttggaaactggtttaagagagaacgattagagagaggagggttgacatcatctgcatattatatttatggagtgccaggacaggcatggaaatatgaaagtgcaaaaggaatacaatttcagaaggatttattcacatttatgatttacatgcgttaaaatgtaagaaaaaataacaaaggatagggaaggagaagttaaatgaacaaagttaaaaagatattgacaacattgatggcagcaacattaactgtttcaacaggattaacatccatgccaatgtttgcacataacgtaaaagcggagtcaaaggcagaaacaataagcagtgatacgaatgatatgtcacagtataagaaaataaatggaatcagcagtcagacggttttaggagcagatttttcccattatcaattgcaaaaaaatgcgtggaaaaaagtctggaaaaattacaaaggaatcgaagtttccaatgtatttgaatatgtaagatcacaggggatcaatacgatttctgtgaaagttgcagtgaacccagcaaaagataaagatggtaatgaaagctatctgtctttagaaaacgctaagagaacattaaaagaagccaagaaagcaggattaaaaacaaatgttacattattatattctgatgatataacgtatgcaggggcgcagaaattaccagatggttgggatactgattcagcagaagaaaaagcactggagtatacaaaaaacgtcatcaaagaattgaaggcagcagatgcagtcccaacgatgatcacgatcggaaatgaagtaaactataatttcttaaatatgagtagtggagatggatgggaaggctttgttgcaatgagcaaaatctcgaaaatgatcagagaagaaggaatcaaaccggctgttagtgtatcggcaccaacaacagatgcttcagatattcaatggatcattggaaaattaggaaatgctgatgttgattatgattatattggagtaaacatctatccggatacacacaatgacaattatgtaaaaacattaaagaatacagtagaagaaaaggcagcaggaaagcagatgatcatttccagtgtcaaatgtccatggaaagattcagaaggaaaagccagtataacgacacagacaaagagcatttatgattatcttcaggcaacgatcgatgagaaaaatgcaggtggattgatctatgatgatgcagattttgtcggggcatgggactcattctttgatgaaaatggacaagcaatgtcttcacttgcaatctttgcttatgcacaaggaaatcaggttgatgtaagcagctacaaagatccatgggaatacggtggagatacaggattaaaagatcaaaaagtaacgatcaaaaaagtcaaaggaatgtctgagagttctatccgaggaatggatatttcatcttatcttgcattaaagaaagcaggagtgaaatattatgattatgaaggaaatgagacaccgttattaaaagtacttcatgataatggaatcaattatatcaggatcaggatctggaatgatccgtttaatgcagatggggaaacctatggcggtggtggaaatgatgtttccacaggtgtagagatcgcaaaagaggcagcccaatatgatatgaaagttctgcttgattttcattattcggatttctgggcagaaccagcggttcagttagttccaaaagcatggaaaaaggatgtaaataatacagaaaagatgtgttcagatgtatatgatttcaccaaagaatctattcagaaatttaaagatgccggggcaaacattggaatggttcaggtaggaaatgaaattaccaacggacttcttggaatatactctaacagagacaaaggagaatcttttaatgtcatctggggagataaaaagaaatcaacagaagtaaataaatatttaaaagccggaattaaagcagtcagagaatatacaccgcaggctttggttgcattacatcttgaaacaccaaatgtatggaaatacaaaacgatcatgaatacatggaagagagataatgtggactatgatgttttaggatcttcatattatccattctggtccattgcagcaaaagcaaatacgccaaagacattgaaagatgtgcagacactggccgcttcctatggaaagatgtttgcagtattcgagacaagctgggttaatagtttaaatgatggagacggtacaccaaattctatcggagacagtacaaatacaggtgcatatgaagtaggaccacaaggacaggtaaatgaacttacagatctttatgataccgtgttatcacaggataatggattaggtacattctattgggaaggtgcatggattccggtaaaagcaggatggacaaactgggaatataataagcagattgcagatcagtatggtacaggatgggcatcgaaaggtgcacttggatattttccagattctaaaatgtattacaaaggaaaagcagcatggggtggaacaagctgggataatcaggcactgtttgatattaacggatatccattgcagtcattaaaattctataaagattctgtatccaaaggaaaagaacagatcatagcattgaagattgttgataaaaatggaaaagaagtttatgcaacacagtatgtaaaagtggaagttggaaagagccgaacgatcacattaccaaaattttctggatattatccaagcaataagaattaccaactgaccgtaaaaggtgtgaaagaagaaaatgcaacgcaaagtgttgtatatacaagaacagcagcaggacctgcgatcagttataattaccgagtgaaagttacaaagaaaaattataaactttacaagaatttcaaatggaagaaatccaaaacaaaagtttataaaaagacatatgtagcaaaatatagatatgatcataagaatggaaataaatatcttgctctttatacaaaaggtggtaaatttgttgggtacattaataagaaagcggtaaaacgattaggatcagcaacacagccagagcagggaaaagcatacacttatggaaaacgtgtaaagatcaagagtaaaaaatataaactatataagaatttcaaatggaagaaatcaaaaacaaaagtttataagaaaacatatgtagcaaaatatagatataaacatgagaatggaaataaatatcttgcattgtatacaaaatcaggaaaatttgttggatatatcaatacgaaggctgcaaaagttgtcaaataacaggagggtagtttatgcaaaaggtaagaaaactggtaacaactataatgatcgcagcattgatcacggcgatggaaggaacaacaattttaccgttatcacatcatgtaaaagcagatacgaatactgtctcacaaaccagtcaggcagagaatgatctgacgaaatacaaaaaaatcaatggaattggagataacacggttctaggagcagatttttcccattatcaattgcaaaaaaatgcgtggaaaaaagtctggaaaaattacaaaggaatcgaagtttccaatgtgtttgaatatgtaagatcacagggaatcaatacgatttctgtgaaagttgcagtgaatccaacaaaagataaagagggtaatgaaagctatttgtctttagaaaacgctaagaagacattaaaagaagccaagaaagcaggattaaaaacaaatgttacattgttatattctgatgatataacgtatgcaggggcgcagaaattaccagatggttgggatactgattcagcagaagaaaaggcactggagtatacaaaaaacgtcatcaaagaattgaaggcagcagatgcagtcccaacgatgatcacgatcggaaatgaagtaaactataatttcttaaatatgagtagtggagatggatgggaaggctttgttgcaatgagcaaaatctcgaaaatgatcagagaagaaggaatcaaaccggctgttagtgtatcggcaccaacaacagatgcttcagatattcaatggatcattggaaaattaggaaatgctgatgttgattatgattatattggagtaaacatctatccggatacacacaatgacaattatgtaaaaacattaaaaaatacagtagaagaaaaggcagcaggaaagcagatgatcatttccagtgtcaaatgtccatggaaagattcagaaggaaaagccagtataacgacacagacaaagagcatttatgattatcttcaggcaacgatcgatgagaaaaatgcaggtggattgatctataatgatgcagattttgtcggggcatgggactcattctttgatgaaaatggacaagcaatgtcttcacttgcaatctttgcttatgcgcagggaaatcaggtcgatgtaagcacttataaagatccatgggaatatggtggagatacaggacttaagaatctaacagcttctgtcaaaaaacttaataatatgtcacaaagttccattcgaggaatggatatttcatcctatacagcactaaagaaagcaggcgtaaaatactatgattttgacggaaaagaaacatcattgttaaaagtattgcatgataatggagttaattatattcgaatccgtatctggaatgatccaacaaatgaaaaaggagaaacatacggaggtggtgcgaatgatgtggcagctggtcttgaaattgcaaaagaagctgcacagtatgatatgaaacttctgctagatttccactattctgatttctgggcggatccagcacttcaaaagataccaaaagcttggggaaaagataaaaatgatacagaaaagatgaaacaaaatgtttacgattttacaaaggatacgataaagaaattccaggaagttggagcagatatcggaatggtacaagttggaaatgagattacaaatggaatgcttgatatcatgccagattattcaaagggagaaacttataaagatacatggggaaatgcaaagaatgccaagattttatgtggatatttgaaagcagggatcaaagcagtcagagaatgcacaccaaaagcattagttacactgcatcttgaaagtatgggttatggaaaatgttcagaaattatgaatgcatgggaacgaaatggagtggactatgatgttttcggtagctcattttatcaattctggcaaggaaattccagtaaaaatgcattagctggacttcagaaaatagaaaatcttgccaagtcaagaggaaaaatgtatgcggttatggaaacaagctggcttaacagtttaaaagatgcggatggtacatcaaatgtcattggtgaaggacatgcaaatgcaaaagtatattctgatgatccacagggacaggtggatgcattgacggatatgtatcagacattgttatcaaatgataatgggcttggagctttttactgggagggagcatggattccggtaaaagcgggatggactaattggaagtacaataaggatatgtctgatcgttatggaactggatgggcggctcagggagcaaaaggatactatccagataacaagatgtattataatggacaaccagcatggggcggaagcagctgggataaccagacgttatttgattccaatggatatccattacagtcattgaagttctacaaagattctgtgtccaaaggaaaagaacagatcatagcattgaagatcgttgataaaaatggaaaagaagtatatgctacccagtatgtcaaagttgaagtaggaaagacccgcaagatcacattaccaaaattctctggatattatccaaagaataaaaattataacatgacattaaagggaacacaggaaggtaatacagtacagaaagttgtatatacaagaacagcagcgggacctgcgatcagttataattaccgagtgaaagttacaaagaaaaaatataaactttacaagaatttcaaatggaagaaatcaaaaacaaaagtttataaaaagacatatgtagcaaaatatagatatgaccataagaatggaaataaatatcttgctctttatacaaaaggtggtaaatttgttggatacattaataagaaagcggtaaaacgtttaggatcagcaacacagccagagcagggaaaagcatacacttatggaaaacgtgtaaagatcaagagtaaaaaatataaactatataagaatttcaaatggaagaaatcaaaaacaaaagtttataaaaagacatatgtggcaaaatacagatataaacatgaaaatggaaacaaatatctcgcattgtatacaaaatcaggaaaatttgttggatatatcaatgccaaagctgtgaaagttataaagtaatttaggtgaaaaaatagaattctgtcgatgcaggattctatttttcatttatgaaaataaataaagtattgacattaaaagttggtagtaccataatattgtatacaagaaaaaagacttaatatgaaaaactggaggattgtatgaaatttcttagacaatttatgattattttactactctcttttttgggagaagtgcttaagatgtttataccattgccaattccggcaagtgtgtatggactggtgttaatgttggtatgtctgatgactggtgttttgaagacgagtcaagttaaagatgcagcatttttcctgattgagatcatgcctgttatgtttattccggcagcagctggattgattgattcgtggaaagttttacagccattattactgccaatactagtcattactgtagtgatcacagtatttgttatggtaatcacaggaaaagtagcacaaatgatagcacagaagagaggaatcaaaaatgaatgaaatgttcagacaatcattgtttgcaggagtaacgatcagtttgattgcatatgagatcggactatttttaaagagaaagttgggattagcgatattaaatccattattagtatctatagttattgtgatcctggcattgaaagtatttggaatcagttatgaagtatataatgcaagtgcaaaatacatatcttatttgttgacgccagcaactgtgtgtcttgctgtacctttatatgagcagttagaattactaaagaaaaataaggttgcggttgtttgtggaatattatcaggaacattagcaagtttaacagggatttttgttctttgtatgttatttggatttaaccaccaacagtatgtaacgatgcttcctaaatcgatcacaacagcgatcggaattggaatatcagaagaattaggtggaattgtgacaattacagttgcagtgatcattattactggaattcttggaaatgtgattgcagatacagtatttcatatatttaaaataaaaaatccattggcaaaaggcctggcacttggaacagcatctcatgcgatcggaacggcaagagcaattgagatgggaccagtcgaaggtgcaatgagcagtctggcagtagcagtagcaggacttttgactgttgtatttgtatcaggatttgctcaacttatttaaaaataggaggaagagatcatggtagatgagaaaatgatcatcacgatcggaagagaacatggaacaatgggagataaagtagcagaaaaaattcgaagacaatttgaactgccactttatgacaaggcgcatcttctaagagtagtagaaggaacggatgattatgatgaattaaatgcattttttaatgacagaaaagtaaacagtctgttatatgcgatcgcaatgagtgagaatgtaagttctaatgatgtgcctttcgggattatcaaaaagattattggtaatacgggaggcgtcgtgatggatagctgtggaaattatcttttcagggaacgtccgaatacggtaagaatttttatgcatgcagacaagaacattcgaattaaaaatcttatgaaatatcttggaataagcaaagaacaagctgaaaaagaaatagaaacagaagattcaaaacgttatgaatttcataaatattacacaaatgaaatatggggaatgtccaatggatatgaattatgtctggacgaaggaatccttggaattgatggatgtgtaaaaatgattttggactatctgaaaataagaaatttaatttaaaaaagttcttgacattacaaaaataatatgtataatagatagaggtggttgcaacagaccacctcgaatataaatctggctccatggtcaagcggttaagacgcgaccctctcaaggtcgaatcacgagttcgattctcgttggagtcataagctacaaacttcgtatttatgcggtttgtagcttttttattttgtttatatttgaattggttaaaggaaagggttaaagtttttgaaatattaaatctggaataaaaatataacgatcaagaaataaaaaatccccctggcatataaaatgccaaagaggattcaaacaaatgtcaaagtgctgattaaagcacaaagatattatatcacacaaaaaacaaaatgcaataatcacttgacaaaaaaatatcaatatgataatctacaacaagagtgaatctgaactatcgggtccatgaaggggcacaccacctcgggtgtgatgcttctttgtggaccctttttttgttccttttaaagataaaaggaaagtcagtcaaggaggaaagcagatgagattaaatggagagacaaaaacattaaaagaccctgtcgcattatctgatttcttaacacaggaaggattttcagataagagaatcgcagtggaaagaaatggagaaatcgttcctaaaggggaatatgcgaatgtgatcttaagtgacagtgacacattagagatcgtagcctttgtcggtggcggatgatctgaagataacaggtacaaagagataagaaaattatgcatatataaaggagaataacatgaaacaggacaagttaatcatcggtggacatgaatttgattcaagatttatcttaggatcaggaaaatattccttagatctgatcaatgcagcagtgcagaatgcaggagcacagatcattacattagcacttcgaagaacgaacacaaatgatacagctaatattcttgactatattccagaaggtgtcacacttcttccaaatacatctggagcaagaaatgcagaagaagcagttcgtattgcaagacttgcaagagaagtaggatgcggagatttcgttaagattgaagttattcatgattctaaatatctgcttccagataactatgaaacgatcaaggcaacagaaatccttgccaaagaaggatttgttgttatgccatatatgtatccagacttaaatgcagccagagatcttgtaaatgctggggcagctgcagttatgcctcttgggtctccaattggatctaacaaaggaatctgtacgaaagactttatccagattttgatcgatgagatcgatcttccgatcatcgtagatgcaggaattggaaaaccatctcaggcatgtgaagcaatggaaatgggtgcagctgcagtgatggcgaatacagcaatcgcaactgcaggtgatattccagccatggcagaagcatttaagaaagcaattgaggcaggaagaagcgcatatctggcaggacttggaagagtcattgaaaaaggttctagcgcatcatcaccattaacaggatttttggaggattaatcatgagtgtaagaattgatgagaatacagatcatatgaaatatacggatgatatggaagcgattgattcagatatcatggaccgtgtcatcgcagagatgaacagctatgatgcagacatttatacagcaaaagatgtcaaagaagcattggcagcagaaacttgttctgttgataatttcaaagccttattatcgccagcggcattgccgtttttggaagaaatcgcacagaaagcacagaaagagacaagaaaacattttggaaactctgtagcgatctttactccgttatatattgcaaactactgcgaaaattattgtgtttactgtggatttaattgccacaacaagatcaaacgtgcacagcttaatgcagaagagattgaaaaagaaatgcaggcgatcgcagagacaggattggaagaagttttgatcctgactggagaaagtccaaacaaatcaagtgttgagtatatcggagaagcatgtaagatcgcgaagaaatattttaaactgatcggtcttgaagtatatccaatggattctaaagattatgcatatctgcatgaatgtggagcagattttgttacagtcttccaggaaacatataattcagacaaatataagacactgcatttgggtggaagaaagagaatattcccataccgtctcaatgctcaggaacgcgcgatcatgggtggaatgagaggtgtcggatttgctgctctcttaggattggatgattttagaaaagatgcactggcaacaggaatgcatgcatatcttttacagaaaaaatatccacatgcagaaatcgcattttcatgtcctagattacgtccgatcattaataacgataagatcaatccaaaagatgttcatgaaccacagcttctacagatcatttgtgcatatcgaatctttatgccatttgcaagcattacgatctcaacacgtgaatgtgaaagattccgtgacaacatcattcagatcgcagcgacgaagatttcagcaggagtaaatgttggaatcggtggacacagtcaggaagaagaaaaaggtgatgaacagttcgaaatcagtgatggaaggtcagttgatgagatttatcaaatgatcgaggacaatggcatgcagccagttatgacagattatatttatgtataagaaaacaaaaaagtatatagtatacacaatcccggatcaaaataaaagatccgggattttttatcctaggaaaatccgaaggaatccactatgcaataaaaagcccgccgctcctaaaaagaagaatatagagaaagatcaaggatttttaacataatatagcttgtagatacttggctcagtagagccattgagcaagaagcctccacttcaaaatcagggatttaagtggtgggagcatgtcaccgagatctgggcggttgcaaccaatatatatattgaaggaaccttcccgaatggtgtacaatatgatatggcaagtgcgatccagttaatgcacaatatgatggtggctcatgcaaaagctgttattgcatacaaagaagcaggccatgaagggaagataggtatcgttcattcgttagaaagtaaatatccttatgataaaacgaaagacgaagatgttaaagcggcaaaaaatgaagatgtattaaataatcagttcttgttagatgcaacattccttgggaaatacagggatgaaacaatggagatcatcaatcgtttggtagagttaaacaacggaagcttttatgcaagcaaagatgatatggagatcttaaaagaagctgcatcttacaatgattatcttggaatcaactattaccagagccgttttatcagatattatgatggggaaaatgatatatttcataatggaacaggagaaaaaggtactttaagattctgcttaaaaggtgtcggagaatgtatggataaagaaggaattccaaagacagactggtatcgcgaagtaagcaagacaaaagaactgtaaaattgcaatggaggaatgagaaatgaaatatcagggaatcatttttgatttcaatggaacattattttttgacaatgataaacatgtgaaagcgtggaatgagatctctaagatcttacgaggaaaagaaatcacgttagaggaattacatacgaaactaaacggaacaccaaatatacaaaatattttatattttacagatgggaaggcaacaaaagaagaattagaaaaatattctcagaaaaaagaagaatattatcgtcaattctgtaaagaagatacggaaaaatttcatctggtagatggtgtatgtgagttttttgatcatttgaaagaaaaagatattccatttacgattgctagtgcatcaatcaaagaaaatattgatttctttattgagtcctttggactggaccgctggatcaagccagaagatatcgtttatgatgatggaacatatgagaataagatcgcaatgtttcataaagcagccgatgtgatcggcattgatatgaaagacattagaatttatgaagattccaattctggaatccgaaatgcatatgatgcaggatgtgaacagatcgttgtgatctgtgacaaggaaaatgaagaagaatttttaaaacgtccaggagttatagaagttatgcaggatttttcctttgcaaaagaattgtaatacaaatttaaaattgattttagggagtttcgtagacgaaactccctttttgtgataagataaattgaatataccttaatcaataaatgagaaagggtataatcttttgaaatataagaagaaagatataaaggagagttcgatgatcaatcagttagtaaacaatattaaaaaattagatgcccctattgttgttggattagatccaatgcttgattatgtaccagaatatattaagaaagcagcatttgctgaatatggtgagactttagaaggagcagcagaggcaatctggcagtataataaaggaatcattgatgcaacttatgatctgattccagcagttaaaccacagattgctatgtatgaacaatttggagttccaggacttgttgcatttaataagacatgtgaatatgcaaagagcaaaggtcttgtgatcatcggagatatcaaacgtggagatattggatcaacatctaaagcttatgcgatcggtcatgtaggaaaggttgcagtgggaagcaagacatacagcggattttgtgaagattttgtaacagttaatccatatcttggaagtgatggaatccgtccatttatggaagtatgtaaagaagagaagaagggaatgttcatcttagttaagacatcaaacccatccagcggagaattccaggatcaggagatcgatggaaaaccgttatatgagatggtggccgagaaagttgcttcctggggagaagaactgatgggagattcttacagctatatcggtgccgttgttggagcaacttatcctaagatgggagaagtattaagaaagatcatgccaaaatcatacatcttagttccaggatacggagcacagggtggtcaggcaaaggatcttgcgccattctttaacgaagatggattaggtgcgatcattaattcttccagaggaatcatctgtgcatataaacaggatgcttacagtcagtttggagaagaaaattacgcagatgcatcaagacaggctgttctcgatatgaaagaagatttaaaacaggcctgggtaaaataaaagaacacctattttgtgagtaaagaaaacagccagataaaggagaattgcaagatgagtaagaaacaggtaatggcagagatcattcgtcatacatctttatcagacggaatctttgatatgacattgaaagcagaagagattgcgaaagaagcaaaagcaggacagtttatttctgtttatctgaataacaagagtaagatccttccaagaccgatcagtatctgtgggattgataaagaagcagggacattaaggatcgtctatcgtacggttggagatggaacgaaggaattatccgattacaaagaaggtgagatggtcaaaatcttaggacctttaggaaacggatttacacagaaagacaaaaaagcaattttaatcggtggcggaatcggaattcctccgatgttagaattaatgaagcagttagattgcgacaaaacagcagttttaggataccgtgacagtgatatgttcttaaaagacgaatttgaggcagttggagatgttgtgatctctacagaagacggatcttttggaacgaagggaaatgtcattgatgcgatcaaagagcagggcgtggaaggaagcatcatctatgcatgtggtccaacaccaatgcttcgaggaatcaaagcatatgcagaagagatggggatcgaagcacagatttccatggaagagagaatggcatgtggaatcggtgcatgcttagcctgtgtttgcaagtcaaaagacgtagattcccattcacatgttcataacaaacgtgtttgcaaagatgggccagtattcgacgccagggaggtggaactataatgaatttatcagttgatattgccggagtaacaatgaagaatcctgtgacaacaggatcaggaacatttggttccggagaagaattcagtgaatttgtcgacctttccaaattaggagcagtgacaaccaaaggagttgctaatgttccatggccgggaaatcctgtgcctagagttgcagaggtatatggtggtatgttaaatgcgatcggattgcagaatcctgggatcgatgtgtttgttgaacgagatattccatatcttaagaaagccggagcaacgatcattgttaatgtttgtggaaaatccgaaaaggattatctcgaggttgtagaaagacttgctgaccagccagtagatttattagagatcaatgtatcttgtccgaatgtgaaagaaggcgggattgcttttggacaggatccaaaagcgttatatgatattacgaaggcagtgaaagcaaaagcaaaacagccgatcatcatgaagttaagcccgaatgtcacagatatcacagagatggcaaaagctgcagttgatgcaggaagtgatgctctttctttgattaatacattaacaggaatgaagatcgatattgaaagaagagattttgtgcttgccaataagacaggtgggatgtccggaccagcgatcaaaccagttgctgtccgtatggtatatcaggttgctaacgctgtggatgtgccaattatcggtatgggtggaatctcaacagctgaggatgcattagagtttatcatggctggtgcaacagcggtatcagtaggaacagcaaactttatcaatcctgcaacgacacttgaagttgttgatggaatcaaaacttacatggaaagacatcagattaatgatattaacgaattgatcggatgtgtcaaatagataataaaaggaggatgagggtatgaatattttatttttcctgactccgaaaagtgaggttgcctatatccctgccaatgaaagtttaaggcaggcatttgaaaaactaaaatatcatggatattcagcagtgccgacattaactgatgatggtaaatacgcaggaacgatcacagaaggtgatgtattgcgtgccatggaatctatgtgccattggaatatatcagaagctgagaaagtcaaacttatggatgtaaagagaaagagaaatattcaggcagtgacgatcagcacagatatggatgatcttgtcgatgtgatcacagatcagaattttgttccggtcattgatgatcaggagaaatttatcgggatcgtgacaagaaaagatgtgattcgtttttattatgacgaataccgcaaattagcaaagaatgaataagatggaggtttaaatagaagatggaacagtataagagagagtttatcgaatttatggtagaaagtgatgtattaaaatttggagaatttacattaaagagtggaagaaaatctccatttttcatgaatgcaggagcttatgtgacaggatctcagttaaagagacttggagaatattatgcaaaagcaatccatagtacttatggagatgattttgatgtgttattcggacctgcatacaaaggaattccattaggagttgtaacagcgatcgcatacagcgaattatatggaaaagaagttcgttattgttctgaccgtaaggaagcaaaagatcatggtgcagataaaggaaacttccttggaagcgaattaaaagacggtgaccgcgtgatcatgatcgaagatgttacaacatctggtaaatccatggaagagacagttccaaaagtaaaaggagcagcaaacgtagagatcgttggattaatggtatccttaaaccgtatggaaatcggtaaaggcggagaaaaatgtgcactggatgaagtgaaagaattatatggatttgatacagcagcgatcgttgatatggaagaagttgtagaatgtttatataacaaagaatgtaatggaaaagttgtgattgatgatacattaaaagcagcaattgatgcatactatgaacagtatggtgcaaaacattaaggatggttcttgtgacggttgagaaaaagaagttagccagacgaggaataaaagttatattttatctttatatcatagttatattttattttgtattattgagtgaacgatatgggagggatacaggatatgatacctcccatatgaacttagttttattcaaagaaatcaacaggttctggacatacagacatcttttgtccaccgaagcagtggtcacaaatctgtttggaaatatttttgcattcagtccatttggttttatgatcccgatcgtgatcaataagaaaaaggcattttttcgtgcagtgtttgcaacttccttttttagtttagtgatcgagacaagtcaattgatcatgaaagtaggggtatttgatgtagatgatcttctgatgaatacggttggtggattgatcgggtatatgatatacagggtcgtagtagcagtatatgatttatataacagaaagagggcggcaaaatgaagagaaacaaaagaaaaacatttgcatatcgtccatctgacaagattatttcacgggaatcaattgtttctgtgattttaggagcagcagggatcattggatattacctgctgcttttcggttccataaagacaggaggaacaagcagtccattaagtggagctggaggatggatcttgctggtagtatcagctataggattatattttggaatacaaagtatgaaagataccgcagcagtgatgaaatggaagatcattggatgtacttgcaacggaattgtgctggcagtatctgtgatcatttttgtgattggaataattgcaatgatctaagtaaagaaaggaagagatgacttgaatacaatgttatcagaaagacatgaattaaataagatcgcactgttagaattaaagaaagatgtagaagaaacaagagaattttcttcatatttttctaaaatggcagatcttttattatatgtaaatgagatttacgataccaaagagaggacattagaacagttaaaacagtggaatagaatatggtatgaagagatcagccaagaacaatatgcacatagttttggaaatccagaattttgtacagaaaagtttggaaaagagtatggtcagatcttcgcatttttatatgcagagatgcgcagtggatttatctatgcaatcgaaggaagactgtttgaccttgtgatcaacaatgaattgttcttggaaatcagcaatttatttttgtcaggagaagaacatccgcagaagatcaagcatattgtttttgatcatatgagagattacagcgaggatgtttttgagtacagaatcagagaacagttagacccagaacttgattttgcaacaaagatcgtgatggaatctgatctcagtgatccagatattttgtatcaatatggagaatatatttccgaaaatgaaattgatactttaaagtttttaaataaattgccacaagaagagatcacagcaatggccaaaacatatgttgatggatttcatgaaggatttatcatcaataacattgatatgagtccaaaacgaagtgttaatatccgttatacgatcggatttgaaccagttgtcagagaggcagttcgtttattctcagaaattgggcttgcaccgatcatctatagaagtggcgtatctgttttaacacgaggacttcataagattggttatgtttcatcttctccaaacccacagtatgaatatgaccacagatatgatcaggcgatattctttgataatcgttttatgaaacataaattagaatgttatcataatgcatatgaacattataaagatgaagcgtatgtgtttgctggaccagcttgcatggaaacatttggggaaataccttttttaccagagaataaagaagagaatttaaaattaagcaagaagcagcaggagctttctgtggaatttcagataaaagcctcagagatcatgaatcaatatatcaaaccagagcagaggagctttacgatcatttcatatccaattcctgagatcggggataactttgaagagatttttaaagaagtcgtgaaagttaatacattggataaagacaaatacagacagattcagcagcatttgatcgatgccctgaatcaggcagtggaagttcatatcaaaggaaaaggaaagaataagaccgacctatacgtagcgatgcatgagatggatgacccatccaaagaaacgaattttgaaaactgccttgcagatgtcaatattccagttggagaagtgtttacttcaccaaaattaacagggaccaatggagtactgcatgttggagaagtctatctaaatgatctgaaattcattgaccttgaaattacttttaaagatggaatgatttctgaatatacatgcaaaaactttaaaacagaggaagaaaataaggcatttatcaaagagaatctcttatataacagagatacactcccaatgggcgagtttgcgatcggaacaaatacaacagcatatgtgatggcgaagacatatgatatcttatatcagcttccgatcctgatcgttgagaagatgggacctcattttgcagtgggagatacttgctacagtcattgtgaagaaactgaagttcacaatccagatggcaaagaaatcgttgcaaaatataatgaatgctccaaagaaggcgagtatttccagtgtcacacagatattacgattccatatgaagaactggattctatttgtgcgatcacccttggcggagatgagattttactgatcaaagatggtaaatttgtactttctggtacagaaacattaaatgaaccattgacggaaatcggttaaatcagtacaatgataagaaagataaaatcctgaaagggaagtttttgttaatttcataagataaggagaaagaacatggcaaaagtagcaattgtaatgggcagcgattctgatatgcctatcatgaaaaaagcagcagagtttttagatcagatggggatcgattttgagatgacgatcatttccgcacacagagaaccagatattttctttgagtgggcaaaaggtgcgaaggaccgtggagtgaaagtgatcattgcaggtgctggaaaggcagcacatcttccaggtatgtgtgcagctttattcccaatgccagttatcggtattccgatgaagacttccgatctcggtggtgttgattctttatattctatcgtacagatgccatctggaataccagtagcgactgtagcgatcaatggaggacttaatgcaggaatccttgcagcgaagatccttgcaacatcagacgagaaattacttgagaaattagaagcttacagcgaagagatgaaacagtcagttgtagagaaagcagagaaacttgacaaagttggatacaaagattatgaataagaagattcttgcagcgtttttatgcgtatgtatggttgtagttacaggaagttttccagtaagtgcagcaaaaacaaagaagacatacaagattgcaattgatgcaggacaccagggaaagggaaacagtaagacagaacctatcggaccgggcgcgaagatgcgtaaacccaaagtggcatacggaacgcagggagtcaaaacgaaagtaccagaatccaaattaactctgcagattgcattaaagcttgagaaagagttaaagaaacgcggttatgatgtgtatatgataagaagaaaacagaatgtgaacattagcaatgagcaaagagcgatccgtgcaaataaaagtggtgctgatatctgtatcagactacatgcggatgcagcatcagcgaatgttcgtggtgtttctgtgctatacccatcacagcagaatccttatgtggcaaaattaagcaagaagagtaaaaaactctcaaagaatatactggacagttattgtaagtcaaccaaattcaagaaacgtggtttatcaaaacgtgacgatcttacaggaacaaactggagtaagattccagtggcactgatagagatgggatttatgacaaataagaccgaagataaacagatgcagaagaagcagacacagaagaagatggtagacggcattgcaaatggtattgatcaatattttaaataatcaggaggagaagtaacaatggattacaagaaagcaggcgtggatattgaagcaggatacaaatctgtagaactgatgaaagaacacgtaaagagaaccatgagagaagaggtacttggtggattaggaggattttccggagcattttctttaaagaagatcaaagatatggatgatccagtcttactttcaggaactgatggatgtggaacaaaagtaaaacttgcaatgatccttgataaacatgatacgatcggtatcgatgcagttgctatgtgtgtaaatgatattgcatgtgcaggaggagaacctctgttcttcttagactatattgcctgcggtaaaaactatcctgaaaagatcgctgagatcgtaagcggtgtagcagaaggatgtgtacagtcagatgcagccttgatcggtggagagacagcagaacatccaggacttatgccagaagaagactatgaccttgcaggatttgcagttggtgtatgtgacagaaaagacctgatcacaggagaaaacttaaaagatggagatgtcttgatcggtatggcatctacaggagttcacagcaacggattctctttagtaagaaaagtatttgatatgagtaaagaatctttaaatacatattatgatgaattaggaaaaacattaggagaagcattacttgctccgacaagaatctacgtaaaagcattaaagagtgtgaaagatgcaggagttacagttaaagcatgcagtcatatcacaggtggtggattctatgagaatatcccacgtatgcttccagaaggaatgaaagcagttgtgaagaaagacagctatgaagtaccagcaatctttaaacttcttgccaaagaaggagatatcgcagaagagatgatgtacaacacattcaatatgggacttggaatggttgttgcggttgataaagaagatgttgacaaaacaatggaagcgatcaaagcagcaggagatacaccatatatcgtagggcatatggaagctggagaaaaaggagttactttatgctaaaggtggcagtacttgtttccggaggaggaacaaaccttcaggccattatcgatggaatcgagaatggaagcatcacaaatgcgaagattgatgttgtgatcagcaataataagaatgcatatgcacttgagcgtgcgaagaaacatgatatcgaagcagttgcactttctcccaaagattttgagacaagagatttatttaacgaagcattgtataacgagcttgtagaccgtaagattgatctgatcgttcttgcgggatgcttggttgtgattccggagaagatcattcatgaatttgaaaacaggatcatcaatattcacccatcattgatcccatcattttgcggaacaggctattatggattgaaggttcatgagaaagccttggcaaggggagttaaagtttctggagcaaccgttcattttgtcgatgaaggaacggatacaggtccgatcattgcccagaaggcagtagagatcaaacagggagatactccagaagttcttcagcgaagaatcatggagcaggcagaatgggttattatgccgaaagccattgatgacattgctaatggaaggatcaaagtcgaagaaggaaaagtcatttatctataaatcattcagatcacgaaagaaaggaaatgaaagatgaaagttttaatcgtaggaagcggtggaagagaacacgcgatcgcatggtctgtcgctaaaagcccaaaagtagacaagatttattgtgcaccaggaaatgcaggaattgctgaatttgcggaatgtgtaaatatcaaagcaatggaattcgataaactggttgcatttgcgaaagaaaatgcaattgatcttacgatcattggaatggatgatccattagttggtggtgttgtcgatgcatttgaatcagaaggactgcgtgtttttggaccaagaaagaatgcagcgatcatcgaaggttccaaagcattttctaaagatctgatgaagaaatataagattccaacagctgcatatgagaattttacagatccagatgaagctatcaaatatttagaaacagctaagatgccaatcgtattaaaagcggatggattagcacttggaaaaggtgtattgatctgtaatacattagaagaagctaaagaaggtgttaagacattaatgcttgacaaacagtttggcgatgctggtaatgaaatcgttattgaagagtttatgacaggaagagaagtatctgtcctggcattctgtgatggaaaaacgatcaaatgtatgacatccgcacaggaccataaacgtgctaaagatggagatcagggacttaacacaggaggaatgggaacattctctccaagtccattctacaatgatgaagtagaagcattctgtgaaaaatatgtctatcagtcaacgattgatgcgatggcttctgagggaagaccatttacaggaatcttatttacaggattgatgatcacagaagacggaccaaaagtcttagaatacaatgcacgttttggagatccagaagcacaggttgttcttccaagaatgaagaatgatatcatcgacgtgatggaagcctgcattgatggaaaattatctgatgtagaattggaatttgaagataatgcagcagtatgcgttgttttagcatctgacggatatccagagaaatacgataaaggattcgaaatcaaaggattagatatattcaaagacaaagatggatattatgtattccacgctggaacaaagtttgatggtgataagatcgtgacaaatggaggacgtgtcttaggtgttgtagcaaaaggagaaaatctaaaggctgcaagagcaaatgcttacaaagcaacagaatggattgattttgcaaacaaatataagagaaatgacatcggaaaagcaattgatgaagcataatctttaaaggatgatcatataaaaaggatggctgagaaatcagccatcctttttgtagtagtacacatatatgaaattacattgtgataattccaaaagcatttgcaactgagctgatcaaaatgatcgctgcaaaaagcgggcacagatatttgatcataaaacagaaaatcttcttacggcgaaatgcctgtccgtcttttgtgatctcttcttctattttatcaactccaacaacttttgacaccagaaggcaggttgcgatcgcggcaatcggcatcatcacagagtttgttatgaaatcaaagaaatcaagaaattgcattccaagaatcttaaaattcgcaagaggtccatacccaaggcaggaaagcgttccaagcagtaacataaccattcccatgaacacagttgattttttacggctccagtgtagttcatcttcgaacgtcgaaacagcactttctgtcagtgcgatcgaacttgtcacagctgcaaacagtactaataagaaaaatacaataccgatcgcagttccaaatcccatgtttgcaaaaactttcgggattgtgataaacattaaggcaggtccagactttaatgtttcggcattaccgccagagaaagcaaaaacagcaggaatgatcataagtccagccatgatcgcgatcgcagtatcaaaaatctcaacattctctgtagatttttcaatggaagtatctttcttcatataagaaccaaatgtgatcaatattcccattgcaatggataaagaataaaacatctgtcccattgcagatacaacggtcatccatgaaaaatgatcaaagtttggcacaagaaagtattttaccccttcaatagcacctggtctggttacagaatacacagcgatgatcagtgataaaacgatcaggatcggcatcataaatcttgatacacgctcaattccatttcgtacaccagcgtaaatgataccaagtgtaaataatgtaaaaatgataaaacagatttctgtagaccacccattggaaataaatgtcgtaaaataagcatcgccagctaaagttttactatgtccggcaaaatattcgatcaggtatttgatcacccatccaccgatcacagaataataaggaacgatgaggatcggaatgattgcattgatccaaccaccaatagatataaaacgtgagtttccaaagctttcaaatgctccaacagggctttttcttgtcatgcgtccaagagaagtctccgccatgatcaaggtgtaaccgaaggtcagtgcaagtatgatataaacaagtaaaaagattccaccgccatatttagcagcgagatatggaaatctccagatgtttccaagccctacggaagcaccagcagctgataatacaaagccaagctttccagagaaagtgcttcttttgtgtttcttcattataagttgtctcctttaactaatgtttccatacgcattgagcgtatctgaatcagtttaacacagcagcaggaaaaaagcaaagaaactgataaaaatattgtatggaaaatattacatatgtatgccatagaaagacaagtgtttttgtatagtgtgctgaaagtgactgattattaaaaaaaatacttgcaaatatcagaatcatcatataaagtaaatattgcggataagaaaaataaacataggcatttctttctgatgaacaaaaagaaatgaactctggagagtctcataagtgagcgccgaaggtgtacagtttctattaggaaactaatctctcaggcaaaaggacagagctttataagcaatgtattcgatactctttagagctgatttaatcagctcttttttgtatactcagatatgcaaaaatcaagctgttcaaggttacattcgcaaagatctatttttggaggaatgaaaaatgttaaacacgctaaacgatgtactaaacaacgtcgacaattttatctgggggatgcccctcatcatcttgatcctttttacaggaatcttattgacagtcaggcttcgaggactacagatcagacatcttggaaaggcactacattatgtatttcataatgaagatgatggagaaggagaagttacaagttttggtgcattatgtacggcactttcagcaacgatcggaactggtaatatcgtaggatgtgcgacagcaatcgttgcaggtggaccaggagcattattttggatgtggcttgcagccttttttggaatggcaacaaaatatgctgaaggaatgttagcggttaagtatagagtgatcgcagaagatggtcacgcacttggcggaccattctattacattgaaaaaggaatgggtaagaattttaaatggcttgcaaaattattctgtgtatttggaacaatggtaggtttgtttggaatcggaacatttacacaggtaaatggaatcacatcagcagttaataacttttttgacccatccaatgtacatacgatcagcttatttggaatgaattattctattagcgttgttgtagcaggaattatcgtaacaatctgtgcaggacttgttatcattggaggaatcaagagaatctctaaggtatcagaggttatcgtgccatttatggcagtgacatatattggtgtctgtctgatcattgtattcacacatttaccacaggtaccagcagcatttgctgagatcgtacagtcagcatttggactaaaagcagttgcaggtggagcaatcggagctatgacagttgcaatgcagaaaggtattgcaagaggaatcttctctaacgaagcaggacttggatcagcgccgatcgcagcggcagcagctcagacaaatgaaccagtacgtcagggacttgtatctatgacaggaacatttattgatacgatcatcgtatgtacaatgacaggacttgcaatcgttatgacaggtgcatgggatatgggacttgaaggagttgcagtcacaacaaaggcatttgcattaggacttccattccctgcaaaagcatcagcatttgtattaatggtgtgtctggtattctttgcatttacaacaattcttggatgggcatattatagtgaaagatgtctggaatacctggtaaatggaaagaaattcgttatcacagcgttcaaatggttttatattttagcagtatttattggaccatttatgacagttagtgctgtatggactattgcggatatctgtaatggattaatggcattcccgaaccttgtagcactgcttgcgttgaacggagatgttgtatctgagacaagaggatatcttgaaagagttggtattgtgaaaacaacagtaggagaagcataaagaaaatattgctttactttaacactctgatatagtatagtggaactataagatcagaaagggagtaaatgctaatgagcaagaaaatcaagacagaagcggcaaaaagattatttcaggcagtactgacattagagacagaagaagaatgttttacattttttgaagatctttgtacagtaaatgaattagaatcgttagctcagagatttgaggtggcttcgatgttatatgataagcatacatacttagaagttgcagataagacaggtgcttccacggcaaccatcagccgagtgaatcgttcattgaattatggaagtgatggctatgatatggtatttaaacgaatgaagaaataggcagatgcctatttcttctttttcttttctgctttattgtttgactctggttgatagagttcatcgatcattttctcaatcacctgtttccttagatagatatcatatccaagaagtgtaataaaagcaaattgctgcagctgttctttcttcttcgactcctttaattcagcaaaagtagcctcagatttatgaaatacatctgcgatcgaatctcggatcgccgtattatgatcatgctccagcttgaaaatctcattataaatcgtataaaaagaattctttgagtcctgatcatcaaaatgttcatttaaaggatctaacagattcttaatatctgaaattgataaaaaattcttcagataataaatataaattaaaagaatcatgtgattcctggaatatttcttcttattagaaggtggaagaagatggtttttggtatagttgttgatcatggtttttgtaaatatcttatcttcttcgaaacgcttcgtattctttagctgttcttctaaaaaagtagtgacctgatccatatacaattcgatgtttggaaggtcttctggaagcacataatcgagtttcatccattcttcgagttgtttttcaaattccataatgatttctccttatcttatgactatattatacggttattcaaaccatatgacaagagaaaaaacatcaggtgcaacggactggactcgcttcgctcgataaggtataatagcagttaagctttgagaaaggaatttatctatgggaatttatgatacattaaatgaacagcagcaggaagccgttttttgtacggaggggccgcttttgcttcttgctggtgcagggtctggaaagactcgtgtgttgacgcacaggattgcttatctgatggatcagggtgtgaatccttatcatattatggcgatcacatttacaaataaagcagcgaaggaaatgagagagagggtcgatgatctggtcggatttggagcagagcatatctgggtcagtactttccattcaacttgtgtgagaatcttaagaaggcatattgataagcttggttatggaaacagtttcacgatctatgatgcagatgatcagaaatccctgatcaaacagatctgcaagcagtataagattgatacaaagatgatgccagagagaaggatcatcaatgagatttcttctgccaaagatgaatttatgacaccttccgagtacgaaacaagacatcagtatgattttaagaagaaaaagatcgcacagatctataaagaatatcagaagcagttaaaggcaaataatgcactggattttgatgatctgatctttaagaccgtggaattatttcagttccatccagaagtgcttgattattatcaggagagatttcgttatatcatggttgatgagtatcaggatacaaatacgatccagttccagttagtcagtatgcttgcaagaaaatatcagaatctctgcgttgtaggtgacgatgatcagtctatttacaaattcagaggtgcgaatgtaaagaacatcttaaactttgaaaatgtatttccagaagcagttacgatcaaactcgagcagaattatcgttccacgaagaatatcttaaatgcagcgaatgaggtgatcaaacacaataagggaagaaaaacgaagaaactttggactgagaacgaagaaggggatctgatcgaattccatcagtatggaacagaatatgaagaagcaagaaagatcattcatgagattgaagatctatccaaagaaggctatgattataaaaatatggcaatcctttatcgtactaatgcgcagtctcgtgtatttgaagaaagttttatgatcaaaaatattccataccgtattgtgggaggcacaaacttctatcagagaaaagaagtgaaagatattttgagttacttaaaagttgttgataatgggctggatgatctggcagtgcgaaggattatcaatgttccaagacgagggatcggtgcagcaacaatcgagaagatcaatgtgtatgcagttgagcataatattagttttttagatgcatgcttttctgcggatagcattgatacattgggaaatgcaaagaaaaagatcaatggatttgctgatctgatccgtgaattcagacgcaagatgcaggaagggtcgctggaagaattatttaagtatattacagatgaaacaggatatattgcgaatctgaaagctgaagaaacggaagaagctgaaggaagaattgaaaatatcaatgagcttttaaataaagttgtaacatatgaacaggaagcagaagaagcgagtctgtcagaattattagaagagatcgcactggttgcagatattgataatctagaagattcagataatagggttgtattaatgacactgcatagtgcaaaaggtctggaatttccatacgtatttatttgtggtatggaagatggaatcttcccaagttatatgacggtgatgtctgaagatgatgacgatatggaagaagaaagacgtctttgctatgtaggaatcacaagagcaaagaaaaagctttatttaagtgcggcaaaacgaagaatgatgcaaggaagaactcagtttaataaagtttcacggtttatcgatgagattccggaacagctattacagttagacacaggggtcaacttcaaagaaaaacgtccagataaagcattgttttcatcaaatcgcagtaatcgatttagaaaaccatatcaagcaaaatcatttatttcaacgaaaatggatactttaccatatgatgttggagatatggtgaagcatataaaatttggaaaaggaaaagtgcttgaaattgtctctggaggccgtgattacgaggtaacagtagactttgagaaagcaggagtgaaaaaaatgttcgcatcctttgcaaaactaaaaaaagtcgaataaaatgaacgaaaaagttagtaaaatatagttagaagtgatataataaagaaaacgcaaaagaaaggaatgagcggcatggaaaaattaagtgatcttttagaaatggcaaaagtttcagacatcattgcaacaaaaaaagaaaaagaagataacaaaatcgtttgggcgttagcgatcatcggagcgatcgcagcagttgcaggaatcgcatttgcggtatataaatatctgacaccagattatatggatgattttgatgaagactttgatgatgattttgacgatgatttcttcgatgaagaagatgatacggatgtgaaagaagaagacatcgaggaagtagaataagaaagcttcatataggaaactgaaacgaagaaagaacacctgtttttggtgttctttttttgatacaattagcagctttttcctatgatttttttagtaagtctaagaaaaacaaaaaaggataatgaaaaaatataagatcagaaaccgcataaacaggggatttgcgacaaagtgttcaagaaaaataaaaaaagttgaaaaaagttgttgacatttaaaggacaattctatataataaatcttgctgttgaggaaatagagaaacagtaaagcacttacggggtgtggctcagcttggctagagcgcttgatttgggatcaagaggtcgcaggttcgaatcctgtcaccccgactgtaagcgggtgtagttcaatggtagaactccagccttccaagctgatcacgtgggttcgattcccatcacccgctttcatgagtctgtagctcagttggatagagcaacggccttctaagccgtgggtcgggggttcgaatcccttcaggctcgttttttatatatggtgggtatagcgcagctggttagcgcgccagattgtggctctggaggccgtgggttcgaatcccattacccaccctattattttgcctaatagatatgtggtgaagtaatttaattatataagggtgtgtagctcaggtggtagagcacttgacttttaatcaagttgtccggggttcgaatccccgcacgctcactatgcggatgtggcggaattggcagacgcgctagatttaggttctagtgtctacgacgtgcaggttcaactcctgtcatccgcagttcttttaaggattgacaagcataacaagatgtgataaaatatttttgttatgagttacaaaatcatataacacttacggggtgtggctcagcttggctagagcgcttgatttgggatcaagaggtcgcaggttcgaatcctgtcaccccgactataagcgggtgtagttcaatggtagaactccagccttccaagctgatcacgtgggttcgattcccatcacccgctttttaattttataggtaacctataagatttgagtctgtagctcagttggatagagcaacggccttctaagccgtgggtcgggggttcgaatcccttcaggctcgtttttctatatctgtatatattatatagaagtaacacatatggtgggtatagcgcagctggttagcgcgccagattgtggctctggaggccgtgggttcgaatcccattacccaccctgatcattaaattttaatgatgatgggctatcgccaagtggtaaggcacagcactttgactgctgcattcgctggttcgagtccagctagcccagttcttgataattatataagggtgtgtagctcaggtggtagagcacttgacttttaatcaagttgtccggggttcgaatccccgcacgctcattgttgtaagagatatgattttagagagatctaggatcatgtctttttttgatgtatggaaatatgctatcattaaattaacaaagcaaagaagaaatattatgtacgcattcgtacctataagaaagttggattcaaaaaagtttattcaaaatggatgaatgtaaaatcagcaaaaacaaagtaagaaccagtactaaaaacacaaaaatggctgtatctgtgggaattaagcagacacagctgtttttgtataaaaatacttgacaggaaaataaatacttgatatactattcaagcagtcgacaagaaaacaagtgcttgttgttttgcaatatgcggatgtggcggaattggcagacgcgctagatttaggttctagtgtctacgacgtgcaggttcaactcctgtcatccgcagtatttttttgtctaacaaagaaaattaaaataaaatgaaaaaagttcttgacaatcataacagaacgtagtaaaatatattttgttgtgagcgacaaaaacacataacacttacggggtgtggctcagcttggctagagcgcttgatttgggatcaagaggtcgcaggttcgaatcctgtcaccccgattataagcgggtgtagttcaatggtagaactccagccttccaagctgatcacgtgggttcgattcccatcacccgctttttaattttatagaattcctataaagtttgagtctgtagctcagttggatagagcaacggccttctaagccgtgggtcgggggttcgaatcccttcaggctcgtttttctatgtttaaacatattttgatagatagaagcaatacattacggtgggtatagcgcagttggttagcgcgccagattgtggctctggaggccgtgggttcgaatcccattacccaccctgttattttgcttattttagctaaaagacaatgatatatgggtgtgtagctcaggtggtagagcacttgacttttaatcaagttgtccggggttcgaatccccgcacgctcactattagataagaagagacagagttttagatcatttagaactctgtctttttttactttataggaaagttcgcctttggctcctttccaaaagaaaaatagcccacataaaagtgggcagagcaaacagatgatcatggttttagaaaatataaaaaccttcttcaccaaaatcatcactaaacacatcttcatttagaaaataatccatatccagcaggtcatcctcgctcatatggcgaatgtcctcggatgtcataccttttgggggatttgaaatatatttttcgcgtagctctttgatattctttttcatggtagggttcctcctttatatgaggattatagcataaaaagaagtggtcatgcagaagaacgctttccacgggagcgggacattgctttctcgtataattcttcaagaggtacgcggcgatggttatgatatatttctaggatcaccatctgttgtttacaatgaggacagatcagaggatcatagccaaaagaagaaaggatcgcagtacgccaccggttaaaacaacggaaagtatgccgtttttctttcgaaatagcgagatggagttttttatcaatggaacgatgtctggcataaaggccgccataacggatcatcttgaaatgtttttcagggatgtgccggataaggcgtttgataaaatccatgacaggaatggtttcttgaacgtattgatcatcttcgtgacgattgtaatggaaagagacaagatcaccggtataagaatcgaccctggaagtggcaatgacagggcgaccaagataccggccaatatatttggtaacagtcttagggtcacaacggttgggtttggcataaacatagaagccgtgttcatgttccagataacaacgggcagaaacttttttaaaagaaggaccgatgcggagcaacatttccttgaggagagcagtacggaaagcattgcgaaggaaagtatagttgaaatgagagacattacgccagaaagcatcatcactgtaaccgccttcagagatgagacaatggatatgaggattccatttaagatccctgccgaaagtatgcaggaccatgataaaaccaggggtaaagtttttgtgtttgttcattttagagaataagcgaaggacaacactggagacggaatgaaagagacagttaaggagagagcgatcctgcaggaaaaaatcacggagggacgcatcaatggtaaaaacgcaatgacggtgtctgacattaacgagcttaaaggacatagaggtagtgcgatccatggaatatttattaccgcaggtagggcagaaacggctgtgacaacggaaaggaacaaacttgagatttccgcagtggatacagccatacatggcaccaccataagaaggatcaccacagttgatcatcttatcgatattttccatctcagcaggtctgggatgaagagtatatttgatttcttcataatgatctgtaaagatctcttgtaggatattcatgattctattatgaaggaaaaagacaaaaaaagaaacccacccctcaagaatgaggggcaggggagttgaagtgtcgaagacacttttttactttataggaaagttcgcctttggctcctttccaaaagaaaaatagcccacataaaagtgggcagagcaaacagatgatcatggttttagaaaatataaaaaccttcttcaccaaaatcatcactaaacacatcttcatttagaaaataatccatatccagcaggtcatcctcgctcatatggcgaatgtcctcggatgtcataccttttgggggatttgaaatatatttttcgcgtagctctttgatattctttttcatggtagggttcctcctttatatgaggattatagcataaaaagaagtggtcatgcagaagaacgctttccacgggagcgggacattgctttctcgtataattcttcaagaggtacgcggcgatggttatgatatatttctaggatcaccatctgttgtttacaatgaggacagatcagaggatcatagccaaaagaagaaaggatcgcagtacgccaccggttaaaacaacggaaagtatgccgtttttctttcgaaatagcgagatggagttttttatcaatggaacgatgtctggcataaaggccgccataacggatcatcttgaaatgtttttcagggatgtgccggataaggcgtttgataaaatccatgacaggaatggtttcttgaacgtattgatcatcttcgtgacgattgtaatggaaagagacaagatcaccggtataagaatcgaccctggaagtggcaatgacagggcgaccaagataccggccaatatatttggtaacagtcttagggtcacaacggttgggtttggcataaacatagaagccgtgttcatgttccagataacaacgggcagaaacttttttaaaagaaggaccgatgcggagcaacatttccttgaggagagcagtacggaaagcattgcgaaggaaagtatagttgaaatgagagacattacgccagaaagcatcatcactgtaaccgccttcagagatgagacaatggatatgaggattccatttaagatccctgccgaaagtatgcaggaccatgataaaaccaggggtaaagtttttgtgtttgttcattttagagaataagcgaaggacaacactggagacggaatgaaagagacagttaaggagagagcgatcctgcaggaaaaaatcacggagggacgcatcaatggtaaaaacgcaatgacggtgtctgacattaacgagcttaaaggacatagaggtagtgcgatccatggaatatttattaccgcaggtagggcagaaacggctgtgacaacggaaaggaacaaacttgagatttccgcagtggatacagccatacatggcaccaccataagaaggatcaccacagttgatcatcttatcgatattttccatctcagcaggtctgggatgaagagtatatttgatttcttcataatgatctgtaaagatctcttgtaggatattcatgattctattatgaaggaaaaagacaaaaaaagaaacccacccctcaagaatgaggggcaggggagttgaagtgtcgaagacacttttttattttcataggaaatttcgatgaaatcccctatgatataaaaagacatcaatggaaataaaaacaaaatttgccaaaaaagtaaaaaacatattgaatatacaaaaagaaacgaatatactaaacatatcacataggatcaattgaagggaggaaacacgtatgaaaaaattactcacaaggctgttcattgcaatactgatattgacatttactccaacaatgaacactcaggcaaaggcaaagatcaaattgaacaaaacaaagatttctttacaaagagggaaaacttacaccttgaaagtaaaaggaacaaagaaaaaagtaaagtggtcaagcaacaagaaaacgatcgcaactgtaacaagaaaaggaaaagttacagcccaaaagcaaggaacagcagtgatcacagccaagatcggaaagaagaaatacaaatgtaaagtaaaagtatggcagaaaacaacaaagaaaccgacaaagactaatacagagccgaatccgatagggacaagagtcaatccggctgatccaagaacaggaatcacattagatacaacaggaggaaccgtttacttcaaactgacagaaactttaaagggacaagaagcagaaaaccgattattacagatgaatcaatcattagaagaaatcaaacaaggagaatatgaacatacaggaacaaccttagtactgtttgtttatgatgtgcaggccgtgaatgggtttgcagcttatccattaaatggtttggatatcatcaattcttatacactatatgatggaacatgctcgaaaaatataaagaatatagaaagtttctatttatcagaaggttatgaagcaatgataccaacaaatctgaacttatatacaggagcaagcagtaaaatgtacgaagctctctgggttccagatgaaatgacctcatttagtaaccagctatatacaagaaaacttacaccatattgggtgagatatcagttttaaaagaaagctgcatcattcatatacaaacaatctgctatagccaaaaactatatcaaactaaaagaaatacatattttacaaaatcctaatacactgttatactagactcaatcagttgaaacaatacaatataaataacaaaataatagaaagagtacgaggtgaaaagtatgagaaaaggaacattgaaaaaagcattagcattagcactgacaggagcagttttagtcggagcattcgcaggatgcggagcaaagaaagatagcggtgataaaaaagaaacaaagaagatcgttattggagcaagtccatctccacatgctgatatcttaaaagtagcgaagaaagaattaaagaaagaaggatacgaattagaaattaaagaatactctgattacgtacagccaaatacagcactcgaatctggagatttagatgcaaactatttccagcacaaaccatatttagatgacttcaacaaacaaaagaagacacatttagtatccgctggaacaatccattatgaaccatttggaatcttcccaggaaagacaaagacattaaaagcattaaagaacggtgcaacagttgcagttcctaacgatacaacaaatgaagcaagagcgttattattgttacaggatcagggacttatcaaattaaaagacggagcaggattaacagcaacaaagaaagatatcgtagagaacaaaaaagatttagcaatcaaagaaatcgaagcggctcagattccaagatcattaaaagatgttgatatcgcagttgtgaatggaaactatgctttagaagcaggattaaaagtcaacaaagatgcattagcaacagaagatgctgattctatcggagctaaaacatatggaaatgttgtagcagtgaaaaagggaaatgaaaaaacagatgcaacaaaagcactgatcaaagctctaaagagtgatacagtgaaaaaatatatcaatgacaaatatgatggagctgttgtacctctgttctaagagcagaagattgctataaaccataaataatttatggaagtaacaagaaattattgaaaaaatcaactgaaattgttatgattaagctattgtctgtcaggaaaactgataggcgatagcttatctgattttacaggataagaagaaagtccgatgaagtgatcaaaggacaatgaaaaataagaaaggataaagtcatgattgaattaaaaaatatagatgttaccttccaaaatggcagtcatgaattcaaagcagttgataatgtaagcttaaagatcaacaaaggagagatttttggaatcgtaggaccaagtggtgctggaaagagtactctggtacgtgtgatcaatttgttacagagaccaacgaatggagaagtgatcattgaaggatcagatattacgaagtttaaccgaaagcaattaagaaaaacaagattgaatattggaatgatcttccagcattttaatctgatcagtggatcaacgatcgctgaaaatgttgcattttcattgtatgccaataactatccaaaggataagatcaaagacagagtgaaagaactcttagagatcgtacatcttccagaaaaagcagatgcatatccagcaaacttaagtggaggacagaaacaaagagttgcgattgcaagagcattggcgaacaatccagatatcttgttatgcgatgaagcaacctctgcattggatattgagaatacagaagaaatcgtggaattattacgagagatcaatgaaaaaacacatatcacgatcgtatttatcacacatgagatggatgtagcaaagaaattatttgatcgtattgcatttatggaagatggaaagctgaaagaagttacagatatctattctgcctttgcaaatcctaagtcagatattgcaaagagtctggtacaacgcgtattaaatgtagaggttccagagggattaaaaacaaaaacaaatgaagagatccttcgtttaagttatacaggagatgattcttatgatcctgtgatcagtgttgcttctaagaactatgatattacaatggatatcatcaatgggaaagtcgattacatcaggaataaaccatttggtatgttgatcgtgatccttagaggagaagatgcagaacgtaagaaagcattagaatacattagtaagaatgtatataaattagagaggttaggaggaagataatatgaatgaaacattagagatcatccagtcagaatttgctcaggcatcttttgagacctttgagatggtattgatttccatgatcgcagcagcaatccttggaacgatcttaggactagtattacatctggcatcgaatccgattttttataaaaacagggtagttaatggcattacaggaacgatcatcaatgtgatcaggtctttaccatttatcattttgatcattgtattacagccgttggcaagactggttgtaggaacaatgatcggaccaatcgcagcatctgtatctttggcaatcgcagcaatcgcattctatgcaagacttgtggaaggtgcatttagtgaggttgataagggtgtgatcgaagcagcgattgcaacaggagcaagtatgcctcttattattcgtaaggttttatttgtagaagcaacaccagcactggttcgtgctttaactgtaacttttgttagtgtgatcggatattcagcaatggctggagctgttggaggcggcgggatcggtaatcttgcgatcatgtatggatataaccgctatcagacaggagtgctattagtaacagttgttgcacttgtcatcattgttcaggttggacaatggatcggagataagatcgcactgaagcttacaagaaaataagatcagccaaaatataaaacaaaaataagaatttttcatatcaaaataaatattttcttttcttctggacagaatataagtatcaagatgttaaagagaaaaggagatacaagatgaaaaagacgttaaaacttacgagtcttttgtttacactgatccttgcagtatccgttgtatttactggatgtggcaacggcagaaaggattctacgacaaaaggaacaacagaaaataataatgcatcagctacaacggaagataatctggtagacgatgctgaggatgccgttgatgatgtggcagatggagttggagatgcggtagatgatatcgcaaatggttttgataactatgacgatgcacatgattatttattaaaccgtctgcaaaatgacgataaagatggtaagtatgaagttcgaaatgagacaaaagacgaacaggaatacagggatggagccagtggatatcattttgaaatctatgatacatccgatgattctgggaagaaatacggagatttctatgtagataaagatacaggaaagatctacaaacgaaatacaaaaacagagaaattagaagaatataagaaataaaaagaaggcacaggggtgttaatcctgtgccttctttaatgcatttttgatcgcttgttttaataatgtatacgtatactggctttgcccgtcaaatttgatatcatcaatattttgaactttgggaagttgtttattgatctcatttagagaaggttcgatcagaggatacattgttttgatcgatttatttaaatgttttaaagaaatcgattttgctttgccgtcctttaccgtgaccgaaagttctaattcgttttctccaagttttaatggagaagaatagacaccttgtgtgtaaccggaagtttcttttgttttctttgatttatgggaaggaacaaacataaagatcaaaagtaagatcaaaagtattccaagtaagataaagattccggtgtaaataagttcccgtgctttcaatacgacaattttcgtttttgatgacatagttatcctcctaaaagattctatctatagtttatgaatggaatgagatatttagaacatctttacggaaaataaaggataagatataatgatagaaaatggaggaaatgatatggcattacagtttatactagggtctgcgagatccggaaaaacagattttatttatgatcagatgatcaaagactccatggaacacgaagatgaggagttcttttttattgtgccggaccagtcaacgctaaatgcacaaaaacaactggtcacaagacatccacgtcatggaacgtttaacattgatgtggtgggatttttcagattaacttatcgtgtattcgaagaattatcatatattccgaaagaccttttggaagatgaaggaaaatctatggtgatccgaaagatcatggagcagcataaagaagaattaaaagtatttgcgtccagcatgaaaaaacagggatttattgatgaattaaaatctttttttgcagaggtctatcagtatgacgtgtccatggaagatttaaagaagattacagatgggatgaaagaagaaggattacgctcaaagatggaagatattcttcttgtgatggagaattttgaagattatatcaaggaacggtacttgatctctgaacaattgttagatgttctggcacagaaagtggaacgatcagagaaattaaagaatgcaacattctatctggatggatttacaggatttacgccgatccagagaaaagtactggaaaagctattaaagattgggaaaaatgtatatgttggactgactttagatgggcgttacgtgagaagtcagtaccgtgaatatgaattatttgccatgtcaaagaaagaaaaatatgaactgatcaaacttgcgcaggatgcaggaaccccggtgatgccagatatcatctgttggccggatgagagagattctaaggaattacgccatctggagcagaatatcgagcgttatccatatgagatatacaaggatgaaccagaagatattaaaatccgttgttttatgaatccaaggcaggaaagtagaacagtggcaaatgagattgaacgatttgtgagggaagaaggatatcgatataaagatattgttgtattaacagcggatcttgacagctatcaaaatgaattggaaaaaagttttgatgatctgcatattccatatttcgtagatgtgaatcgaaaactgttaaataatccatgtatagaaacactcctttctgttctgaagatgatccagaaagatttttcatatgatatggtatttcgttatttaaaatcaggtttctcgaattttacaatggaagaagcagattttctggaaaattatgtgctggcttgtggaattcgtggatttgccagatggaaccgcccatttgcatcgaagttattttccgatgaagatgttggaagagcggaagccttaaggattcgttttattgaggaagttggaacattaaaaactggattaaagcgaagaggcagtacggtcaagagaaagcttatctatctatatgaatttctggaaacattggatgttgaaggaaagatggtaaagaaacaggagatgtttgaggcgtcaggagatctcattgcggcagcaacctatgcaaaggtttatgaacaggtcattgacctgttagaacagatggcagagattttgggagaagaaaagctttcttatgatgactttttaagtgttttggaaagtggactggaagagatgcagatcggtgtgatcccgccaagtcttgatcaggtcatgatcggtgatatgaaacgaacgagaaccgaagaagtaaaaatcttatttttcctaggtatcaatgaaggtgtgattcctgcagccaatggcggtggaggggttgtcaatgaccatcaaagagaagtgcttgaaacctatggaataaatctggcgcctggcatcaaacagtctgcctatatggaacagttttatttgtatcttacggtgtcaaaaccaaccgatcgtctgtatttatcctatcgcatgatggatgcagcaggaaataataaccgtccgtcctattttattgaaaggattcaacgcatttttccaaaattaaaggttacgatgcaggaagaagaggtgcagacgggctatacaagggaagaagcgttagatcagatgattctttgtctgcaggagatggaatttgatgaaagagacgatgatccggagaaaatgaaatggatgcagacgttatatcatgctttaaaagagttggaacctgtgggtgattatgtagatgcaagattttacaccaatcaggcattgccattgagcaaggaactgattcatgatctgtatggagatacgatttcaggaagtgtaacgagaatggagaagtttgccggttgtgcattttctcattttatgcagtatgggttaagacttcgaaaacgtctggtgcatgaaattctgccgaccgatatgggaaaagtttttcataagacgatggaattagttggaaagcgcagtgattggaagtttgcggatgatgcatcaagagatgaatttgtagaactgatggtcgagcaggcagttacggatatccaaaaagaattgtttgagagcagccacagaaatgaatatgtcctggagcggatgaaacgaatctctaaacgagcggtatgggcgatggaacaacatatcaagaggggtgattttacaccagaagaatatgagattgcctttggagaggaaaatcatttagattccatgacgtttgctttagaagatggagagaaaatgttcttttctggagtggttgaccgtatggacagtatagaagatgatgaaaataaatatttaaagatcatcgattacaaatcaggtaaacagaagtttgattttgccaagatttttcatggattgcagatgcagctgatcatttatatgaatgcaatgatggaattatacgaaaagaaaacaggaaagcgggtatatccggcaggaatgttttattttcatttggatgatccgatcgtcaatgtagaacacgagaatgaggcggaagataagattttaaaagatcttaagatgagtggcgtcgtcaatgaagattttcagttgatcgatcatatggaacatacgggatcagaaggatatctgacactgccggttcgtgcaacgaagaatggatatgacaagagatcttctgttttaaatacaacacagttgttcaatctgggaagaattgtggaaaagaaaatgacagagcttggaaattcattgatgcatggagatatttctataaagccatatgaatatgaaggaagaaaaccttgtgagtattgtgagtttaagaatatctgcgcctatgaagatggtgttgatcaggtagagaagattaagaaagtatcactagaggagggaaaacatgccttggaccaaacaacagcagaaagtcattgatcaaagagatgccgatatcttagtatctgctgcggcaggttctggaaagacggcggtactggtagaacgtattatacaaaagatcacggacgaaaaacatccgatcgatgtggatcatctgcttgtcgtgacatttacgaaagcagcagcaggggagatgaaagaaaggattatggcggcacttgatgaaaaggtgcgggaatttccaggaaatcagcattttgttaagcagctgtcattgatccacaaggcacagatcacaacgatccatagtttttgtatgaatctgatccgtgattatttttatgtgcttggtattgatccgaatacagcaccgggggatgaaggaagattatctgcaataagaaaagaaatattggatgatctgttggaagaagcttatgagaaaaaagaagaagattttatcaatctgatcgaatcttattctccaggaaaaaatgataatatcatcagtgaatatattttaaagttatatgaaaatgcaagaagccacagagaaccagaaaaatggcttgatcaggcagaagaaaatatttcagtagagacaaaagaacagtttgatcaggcaccatttatgaagatcatcttaagagatgcaagattttcgatagatggtgcatatgatacgattcaggaagcattagaactggcactttctcctggtggaccatatttttatgaaaaaacactgcgaaaagatttagagatcatcataaagatcaaagaagcacagacattttctgaattatgtgaaagctttgtaaagatggagaaaccacgactttctggacgtaagaaaaaaacagatgagattgatgaaatgcttcaggatcagtgtaagtatgaaagaaatcaggcgtacaatctgcttgatgatctgaaagcagcatatttttatgaaaatgagtcagaaatttttcatgaattaagaaggattaaaagtccattaaaaggattgatcgatctgacgagagaatttatgatccgttatgatgagaaaaagaagaatgaaaatatcatggatttcgatgatatggaacattttgcgctggaacttttgatcgatcattatgatgaggaaggcaatccagtgccaagtaagatcgcaagagaaaagtccgatggatacgaagaaatctatatcgatgaatatcaagacagtaactatattcaggatgcgattttaaggagtgtatccaaagaatccgaaggcggtcataatatgtttatggtaggggatgttaagcagagtatttatagtttccgactggcaaggccagagctgtttcttgaaaaatatcatggatatcagcaaaagggggaagaatatcagctcattgagctccgtaataatttccgaagccgcagtgaggtccttacatttgtcaatgacgtgttttaccagatcatgcatgaagatcttggaaatatcgaatatactcaaaatgttgctcttgttccaacgatggaatttgaacagggatgtgatgcacagacagaactgttactgttagaatctaatgaagtcaaagactcggaagaagacgcagttgttttggaagccagaatgatcgcaacaaggattcatgagatgatcgatggagaagatccaatgatggtcactggaaaagatgaagaaggcaatatgattttaagaaaagccaaatacagtgatatcgttattttgcttcgttctatgaagacaaatgcggaagtgatccagaaagaattgatgaatgcgggaatcccagcatttgcaaataatcagaaagggtattttgatacggtggagatccgcacgttattaagtttattgtctgtagttgataatatatatatggatattgatcttgcagctgtcttaaggtctccaatgatcgggatatcggaggaagaactaggacgattaaaggtagatggagaaaaagattctctctatgaatgtctttgtgagacgaaagataagatggaaaaatcaaagaaagcactggaattgcttgatctgttacgggatgccaagacatatctgccattaacacagttgatctggctggctctagaaaaaagtgggtattatcattatgcaggagccatgccgcaaggaaaaaaacgacaaggaaatatcctgatgctcgttgaacatgcaaaagcttttgaaagcagccagatcaagggattgtttcattttgtgcggtttatcgaacagtgcagggaatacgatatggattatggagaggcaaatacgatgagcgaagatcaggatctggtccgtatttccagtatccataaaagtaagggattggaatatccgattgtttttgtatcaaagatccatcagaaatttaatttaagggatgggaatggaagtatgatcttccacggagattattttatcggagcagatcatgttgatcccgtttatcgtacaagaaagaagacgatcttaaagaatctgatcaaaaatcagatgacaagagagtctttaggagaagaattaagagttctttatgttgcaatgacaagagcaaaagaaaaactgatcttgactgggatcaagaaagatgatattgactggaatgcaaaaggagaggtcacagcaatcgatcgtttgagcggaaggagttattttgactggatcaaaaaggcacttccgatgattccaaaacaggattatcgattgaagctctatactctggaagatcttttgtggcagcaggaaggaaatgaacttcttcatgagatgaaccgccagatcttctatgaacgtctaaatgatcagattccaaaagaaaatgtaaaagtgttgaaagagagctttgcatatcattaccgtaatgaggcagagacaaaaggtcgtttaaaatattctgtatcagagatcaaacgtatgagtcaggcagcagatactgaggaagtgatgtattcatctgtttctatggagaaagaaaaaaggataccatcatttgtcaagaaaactgaaaagatttcagcggcatccaaaggtacgatcattcacaaagtttttgaatcactagatttttccaaagactatacaatgaaaagtttaaacgaagatatcgaaagatggatctctcttggaaaattaaaaaaagaatatgaaaaagtaatctatcgaaaagaaatcctcgctctgacgagatcagaacttgggaagaggatgaaagaggcagcacagaagaaactgctttataaagaacggcagtttgtgacgggaattccattttctgacatgaacaaagatgcaaaaacggatgattttgttgttgttcagggaattattgatgtatattttgaggaagaagataaaattattttggtagattataaaacagaccgggtcagagaaggggaagaggatattttgatcagacgttatcgcgcacagatggaatcttaccaacaagcattggaaaagatcacaggaaagtgtgtaaaagaaatttacatttattctgtaaccctgcaaaaaacaattcccgtgcatgtatgaaaattctgatttgtcatattctaagaatagaaaatgacaaatcagaaaggaagaagatcatgccaaaggaaaaggattttatagaaaagacattcgaagaaatgaatgagatggaacggttaaaatatgaaactgctgcagaacttggtctgcttgatcaactaaagaagagtggatggaagtccttatcagccagtgaaacaggaagattaggcgggatcatgaaccgtaagataagaaagcagaaggaaagtcaggaaaatacgaaaggaagttaaaatgaacaaaccatgttttatcgcagtgacaaatagaaatctatgtaaacgaccattttttgatgtgatcgaggatctgtcaaagaaagatgtgaaaacgatcgtattaagagaaaaggatctgtcagaagaagagtactatgagatcgcagagaaatgtaaggaaatctgtgacagaaacggtgcttccttaaccattcataattttatcgatgtggcaagaagacttggaatcaagaagattcatcttccatatccggtatttttaaaagaagcggggaatctgtctgattttgaatctgtcagcacatcgatccataagccagaagaggcgataaaagcacagaaactgggggtggattttgtgtttgcaggacatgtctttgtgacagattgtaaaaaaggtctgccgccaaggggacttgaatttttgacggatgtagtaaatgcggtcaagattccggtgtatggaattggtggaattaatgaagaaaatattgcaaagatcatggaatgcggggcagcgggaggctgcatgatgtcaggattcatgaaataaaaattgaaattgaatggtatctatgttaagatgaaaagaagtagcttttgaagaaggtaaggacgtaagatgaagatagcagaacatttaacaaaaccaatttcaaaaattcttaaatttttacttcgaagactggtattcgtgaccgttgcgatcattttacagatgatctggatgacctatatggttgtggtgatcggagaatattccaaagcgatcgaatgggtatttcgcatattcagcattactgttgtaatctatattgcgaataaagatgataatccggcgtataaacttgcatggacgataccaattcttttgtttccgatttttggcggattcttatatctggtcctgggagataagcagccagcgaagaagctccgtatggaacttgaacagtcgatcgaagatacagaatttctgcttggacaggattatggagtgatggaacgactggaacaggaagattatcaggtcgcaggacaggcaaagtatatagatcagtatggtggatatccgatttacgagaattccgatgcgaagtattatccatcgggagaggcaatgtttgaagaactgatcgaggaccttaagaaggcaaagcattatatctttatggaattttttattgtttcaagaggatatatgtgggatacgatcttggaagttctgaaagacagagtcaatgatggtgttgaagtacgttttatgtacgatgatgtaggatgtgtggatctgctcccttataaatattacaaagagcttgagcggtttgggatcatggcgatgccatttaatccgatcaaaccatttgtttcaacggcatggaataacagagatcatagaaaagtagttgtgatcgatgggcatacagcatatactggtggattgaatttatctgatgaatatattaataaggttgaacgttttggatattggaaagatgccggacttaaggtgacgggagatgcagtgtggaatttcactgttatgtttttgcaggtatggaatgcgatccgtaagacagatgaaggatatggagcctttctgccacataagcattatgaagatgcctttaaaggaaagggatttatacaaccttatgcggataatccattagatcatgagatcgttggagagaacgtatatttaaatatcattaatactgcaaatcattatgtttatatttacaccccatatctgatcattgacaacgagatgacaacagctctttgccttgctgccaaaagaggagttgatataaagatcgtaactcctggaattccagataagaagttagtattcttattgacacaatcttattataagcagttagtggaagctggaattcatatttatgaatatactcctgggtttattcatgcaaagtgttttgcaagtgatgataaggtggcaacagttggaacgatcaacatggattatcgaagcctttatctgcattttgaaaatggtgtttttatgtataagaatgatgcagttatgcagttaaaacatgatatggagaaaacatttgagatcagccagaggatcacaaaagagatgtgtcaaggaaatttaagaaaaacattgacgcagagtgtcttacgattactggcaccattactataagaggatgagatggaaagttacagagattttgcaagggtgtatgatgaatttatggatcagaccccatatgatgaatggcttttaaatattttaaatatattcaaagaatataagattgataaagatgcacaggtattagatcttggatgtgggacaggaaagatggcacgaaagcttgcaagagaaggttatcaggttacggctgttgataattctatggatatgctggagatcgcggctagtgaagaggatgatcatattttatatgtattgcaggacatggtgtcattagagcttccgcagcaggtagatgcagcggttagtatctgcgattgtatgaattatattctagaggaagaagatttaaaagaagcattcagaagagtcagagaatttttaaaagaagatggtgtgtttgtatttgatatgaacagtcattataagtataaagagatccttgcgtgcaatacatttgcagaagaccgtgaggatgcgagctttatctgggataatttttatgatgaagaagaacgtatcaatgaatatcagttgagcctgtttattcagaatgagcaaggtacatataacaagtacgaagaattacatttacagaaagcttacgaacaagaagaggttgtaagctttctttatgaagcgggattttcatccgtgtgtgttctggatgcagagacaatggatgaagttaaagaagatacacaaagattatattatattgcaaattgaaaggaaaaaagatgaacgattatattatcagaggaacagcagcaaatgaccaggttcgtttttttgctgcatatacaaaagatgtcgtggagacagcaagacagaaacataatacaagtccggtagcaacggcagcacttggaagattattaacagccggagctatgatgggaagtatgtgtaagaatgacagtgatgtgatcacattacagattcagtgcagtggaccgatcggtgggttgacagtaacagctgattctaaggcaaatgtgaaagggtatgtaaataatccagatgtgatgcttcctccaagtaaagaaggaaaattagatgttgggaaagcattagatttaggtgttttgacagtgatcaaggatattggattaaaagagccttattcaggacagacacatttagtatctggagagattgcagaagatttaacatattattttgcggcaagtgagcagattccaacatctgtagcacttggagttttaatgaacaaagataacacggttcgtcaggcaggtggatttatcattcagatgatgccatatgcagaggaagagacgatcagtaagttagagaagaagatcgcagaatttaaatccgtaacttatgcattagagcatgaacatacaccagagaagatgatggaggatcttttaggtgatatggatatgaagatctatgagaaagttccaacacaatttcattgtaactgttccaaagagagagtagaaaaagcagtgatttctgttgggaaaaaagagattcagaacatgatcgatgatggagagccaattgaagtaaactgccatttctgtaatacacattatcattacagtgtggatgatcttaagagaatgttaaatgaggcaacaagataagccgttttaaatgtggagaatcctgctttgcaggattctttttgaataatggaggaaaactgatgagaacagcgaagaatatacttttgtttgtcttcatactgatcataagtttgaatgtaacagtatatgcacaggagaatggagagaagacagaaaatccggtcaaggtaacacaggaatctgagaatgataaagatgtgccgtttacgaatagtaaaggagagacagtatatacattgtctgcaactacaagggaccgagaaggtgcgatcatgatgccgaaagaccgtattttatgtcttacttcggagacggttgatctaagtgacatcgaagttttgatcgatgattcaaatgaacaggccaaaaaggatcttgaggttgagcttatatttgcgtctaagaataccgcaaagatttgtgtgaatttttcgaaccggtatgtttcgactgatttaaactgggatgggaagattcttgtaaaaaaggcaatgatgtgatcagggagattgcgatcgcttacatgacaccatacataagagatgtgcatgatacaggatttcaaacgttaagttcatggtctggtacatggggcgttttagatggagagcaatatcgctcctctgggattgttgatgtgtatcaggaaaatgcacagatttcttttacctatcagtcacaaggaaatcagggagtgaaagcatttcatttataccaaagtgggaattatacattttcggatggatcatacgatatcaaggctcagaatcaaggtatcaaggcttataatacagtgaatatccgtctgaaaccaacttatatcaagcagttaaaagaagaactggtcaatgacctgtatcaatacagtttagatacaaagcagtgtgtgttcgatgatctgatgattgaatatgaagacggatgtatcataggagaagtcacagattttgtgagactaggacatcaggcaacgatcaagccgttagataagatgacattaaaggcaaatataaaatctacatcaaagatttttcttcagtggaagaaacttgatcgtgtcagtggttatgcaatctatcgttatgattctgggaaacagcgatatgaaaagataaaaacagtttcaacacaggagacttcctatacagattctaagttaaaatctgggaagacatattattataaaattgtgccatatcgttccattacatatacaaatgctggaaatttatgcaaggttgtgaatggttcatcttccaatatcgcaaaatgtatcacaaaaccggggaaaccagtgataaaggcaaagaaatcgggaagaagaataaaagtaaagattaaaaaagtaagcggagccagtggatataaagtatatttaaggaagggaaagaaaggccggtataaagttgttaaaacatataaaggcaatcggacccgtacgtataagagtcgaaagttaaaaagaaaaaagatgtattatgtgaaagtacgtgcatataaaacatatcaatccaagaaatactttggaaaatattcaaaaacgaaaaaagtcaaaattccaaagaagtgatgatgtgagaaaaaagacagatgaggtgattcttctcatctgtctttttcgatttacgaattattctttttcgtcagattcttcggatggagtttctgtttcttgtgcttcttcttcagctacggatggatcatcatcagtatctgtgatgttgatagaaacataatctctgtcgtcttttgatggttcagggaaaatctcatcatcatcaaaagaatcatcatcaaaagattcgtcatcgaaatcatcgtcaaaatcatcgtcggatacttctttaatctttgcaatgatcgctttgatctgatcacgggcaacatataaaataccagcaacggtagcgatggtagtgatcagtttaaaaaggtcttttatggttttcttcataacgaaaaactcctttcttttttattattattttataatgaatcaaaaaaaaatgcaatgtaggattgacaaaacaaaatttcatagtaaaataaatatataaaataaaactttgcaaaacatagaggaggaataaagtgaaacgtttatgtgcaaaagcggcacttgatcttgtgccagatcatgggattatcggacttggtggtggagagacgatcagttatcttgcagaagatatcaaagaagcaaggaaagatgtcaaagttgtgacaccatcagatcatacagcacaagtatgtaaaaagcttggattagaaattgttgataccaaagaagtaaaagagatcgaaattgcatttgacgggtgtgatcaggttgattctgatcttgatgcatataaaagtggaggcggaattcacacattagagaagattattgcaaagatggcaaaagaatatgtattactggtcgatgaaacgaaagtaacagataagttaaataataaagtaccagttgtattagatattattccagaagcagtgaactatgtgacaagtcaggtggaagcaatgggtgcaacagtgaagaaacgtgatgaacatttactggaagtttattatgacactttaccagaactagaagagattgacaaaaacttaaagatgatcacaggggtgatcgagacatcattattttatcaggttgcaacaaaagcattggttgcaggtgaagaaggaatcagagtgatcaagtaagaaagaaggaaagataagatgagtacatggggaattttaggttgtggaacaattgcgaatgagatggcagcaacatttcagaagatgggacatgaaatttacggagtagccaatcgtacaccagagaaagcagaaaagtttgcagacaaatatggagtaaaacatgtttttaaaacatacgaagagatgctggcagatgaaaatatcgatattatttatgttgcaacaccacatagtatgcattatgaaaatatgaagcaggcagtcaatgcaggaaagcatatcttatgtgaaaaagcgatcacagtgaatgcagcacagttagaagaagtgttggaacttgccaaagaaaaaggtgtggtagtcagagaagcaatgacaatttcacatatgcctttatataagaaattaaaagaacgaatcaaagaaggtgcgatcggtaatacaaagatggtacaggtgaactttggaagtaacaaaggttatgattctacacagagattttttgcattagaagcagctggcggagctttattggatattggagtatatgcaacagcatttgcgagaacatttttaagtgagatgccaaatacgattcttacgactgtagaatatttagagacaggtgcagatgaacaatctgggatcattatgaagaatacaaaaggggagatggttgttatgtgtctgacacttcgtgcaaaacagccaaaacgaggagttgtgacaggtgataagggatatattgaagtatatgaatatccaagagcatgcaaagcaacgatcactaatacggcaactggagaagttgagacagttgaagcaggaaagacagaagatgctttaaaatatgaggtagaagcaatggaagcagcgatcgaaggaaacttggaggatgattgccagatcattacaaaagatacgatgcgaattttaacaagtattaagacacagtggggaatgaaatacccatttgaataaggatctgagatgatcatataagaatttatcaaaaagaaatgtgccaaacacacatttctttttttactggacgaagcttttgctatcagttatacttaataagaatgaagcaggaaggagcggtaagatgatccagatttataagaattatgaaggacataaagagttagaagaattagatcatatcgaattggaatcatgggtgatgatcacagatccaacgatggaggaactcatgaatatttcgagagattataagattgatatggatgatcttaaggcagcactggatacggaagaacgttcccgactggagaatgaagatgattatacaatgatccttgtgaatattccggtcgtagaggaagaggaagaaaagaaatggtatgagacgataccgcttgggatttttattactaataagatcgtctttactgtttgtttggagcagacgaatatcttaaaacaatttgttgatggactggtatcaaatttttatacatttatgaagacaagatttgtatatcagattctttataataatgcagcattgttcctgtattatctgcgtgtgatcgaccagagagcaaatcaagtggaagatctgttgcatgagacatatgagaacaaagacttgatccaattgtatgatttagagaaatgcctagtttattttacaacagcattaaaatcaaatgaagtagtattggagaaattaagaaaacatattggccttagacattatgaagaagatgaagaactgttggaagatgtcatcattgagaataaacaggcgatggagatgacggatatttatcataatatcctgcgaagtacgatgtctttgtttggatcgatcattgataataacctgaatcaggttatgaaattcttggcagcgatcacgattattttggaattgccaacgatgatctcgggattgtatggtatgaacgtcaatggtgttggaatgccgtttgcgacgaaagcatatgggtttgcagcaatctcgattttttctttgatcgtctgtttgatcgcggtgtatattttgaagaagaaacatatactataagatattgaagaatcacactaagtggttcttcatgtgttttagggcgtttttttccagacggctgacttgtgcctgggaaatggcgatttcgtctgcaacttctgtttgtgtttttccttcaaagaatcgcattttgataatatcatattctcgatctggaagatgttccattgcttcttttaaggcaatggattccacccagctatcttctttgttttttttatcttttacctgatccataaggtaaagagtatcacctccatcctgataaacaggttcataaagagaaagaggggttgcgatcgcatcaagtgcaaataagacatcttcttttttcatatcgatttcttttgcaatgacgtcgatcgtaggctcatgatttaattttttggtaagaacttctcttgcattgatcgctttatatgcggtatcacgaagagaacgacttacacgcatactatgattatcacgaagatagcgtttgacttcaccaatgatcatgggaacagcataagtagagaatttcacatttagattccggtcaaaattatcaatggctttcataagaccgatgcagccaacttgaaaaagatcatctgcattttcactacttcctgaaaatcgttggatgatactgagaacaagtcgtagatttcctttgatataatgttctctggcaagaagatcaccttgctcgatccgctcaaataaatcttctttttcttcttcagaaagtaaagggagagaagaagtgttaacgccacagatttctactttttttcgtgccataataagttcctccatttgtgattcgtataataaaatcatgtacagatctggtggaatttatacgttgaaaaaaatggaagaggaaattgacttatattttttcaggtgctatgatgaggataaatacgatcaaaggagagtaaagatgaagaagatattagcatcgcttatgatggttggacttattttttgtcttggtggatgcaacgttccatggatgaaacaaaagacagagaaaacgaaggctacgaaagttattcaggcagataaagttgaagggacaatgaaaggaatgaaattaaaggttggtgtatcgaatgatatggcaccattttcatattatgacagtgagcagaagaagatcacagggtttgatattgatcttcttgataaactcagtgaatatctgggctttgaatatgaattatatccaatgaatatgaagaaattagagcaaaagatcaagaacaaagaattagatcttgcaatcgcaggaatttcaatcacagatgaaagacagagagagttttcatttacagacacttattatgaaacatatcttcagatcgtggtcagaaaagacagccagatcacagatcgtaaggagattacagagaagaagatcggtgttgtagaaggaacatccagtgcacaatatgcggaggattatttgtcagaggataacaagatcacatattataaaaacattacaaaagtatggaacgatcttgaaaaaggaacgatcgatgcaacgatttatgatacaacaggaatccagaattatatgaaagaacatgcagataatacgaatcttagtgtgttgaatgaacaacttaattccgaggaaagtaattatgggattatgtttgtgaagggatacaaatatctggatcagtttaatgtagcacttcaggttcttaacaatgatgggacgtatcagaagcttaaggagcagtggatcaagacaaaagaataaaagataagaaagtggcaggaactatatgtaagatgaaaagttcctgccattttgtttgttaagaaaggctcttgtaagattcaaagtgtgagtgtatgaagccatgcagattcttcctcgtcaaggtgtggagaaagtgtgtcatatacgaactgttggtaatcagccaacaattgtttttctttttcgttaaataaagaaaggtcaacaccgtcaagatcgatcggtacaagtgtcaggggttcgaaatgaaggaaagcaccgtattcattttgctgccattttttacagatcagcatattttctgtacggattccgtattttccgggaacatagacacctggttcgtctgtgatgaccatacccggctgtagtactgcatcaagattttcgggatttgatctccaacgaaaagcgtttggaccttcatgaacaccaagaaaatatccaacaccatgtccggttccacaacgataatcaacgccatcttcccagagaggttctcttgctagaatatcaagattacttcctctacatccaaacaggaattttgcattggcaagagtcagcatagattttaataccagtgtaaagtattttctttcttcctctgaaattggaccaagaataaaagttcttgtgacatcggttgtaccaccataatattgtccaccggaatcaatgagaagcataccttcagctttgacatcgacatcggattcttcagtggattgataatgcatcattgcagcatgatctttataagcacagatcgtctcgaaactagggcccatgtaatcgggaagttttttcctttcttcctcgagatggtcagagatcatacgttctgtcatagggatttttctgacgtttttcttaagccagtacataaattttgtcatagcgatcccatcattgatatggcatactttcaaatgatcgatctgaatgtcattttttatagctttcattagttctgttggattcttatcttcaatgatcttgcatttgaataagagattataatgcagatagtttgtaagatctggatttaacaaaacagtttcatgttggtcttttaagaaagcactaacttctgtgtaatcgaggatggaaatgccgtgttccttaaatcgttgaaaagcaactgctgaaatacaatcttttcgaagaaaaagaaaacatttgtctatcgtgatccatgcataactataaaataatggagtacatgcaatgtcatctccacgcaagttaaaaagccatgcaatatcaggaagagaggataagaaaaatgcattggcatcaagttctttcattttttctctgacacgtgccagttttgaatcagtatgttctccactatatttgatatcatgacggtaaattgtggattttgtgatcgcggggcgattatctttggcccagagttcttctacaaaacgaagatcaaaacgaaaagatgcaccatgctgtttcactagttttgcgattttttttccgtaagaagctgagatcgtaaagccgtttaccccaagtgtatcaccttcctgcaggtgctctttcaaaaattcaagaatcgtaggaacactagaaaccccttgtttcatcaatgtgatatcagaagagatctgtccttcagcctgcgtaaaataacgtccatcagtccaaagccatccttcttcgcatccagctagaaaggtaccagcagaaccagtaaaaccagaaatgtattgtctgcatttaaagtaatcatctacgtattcggattgatgcggatcttcacttggaacaagataataagaaaccttttggtttttcatttgttcgcgaagtttcataaaatttagattcatgtccaaaaacctccattttgtcgtattaaaatcctgaaaatatatgttttatataggatttcaggatcggtttatgttaattatagtagatgaatagggattcgtaaagaaaaagcaaatgtaaaaatatatggtattttgtcaaaaaagttgaaaaaaataaaagaaatacggtataatcgggattgaacaaatataaaagtataaaggagaaacttatgaagaatttactagttgctcagtcaggaggaccatctgcagcaatcaatgcgacgatcacaggagtgatcgatgctggaattgagagtggacgtgtgggccatgtttatggtgctctgaatggaattaaaggtgtgctgaacgagaattttgtaaatctcgatgaagtatgtgacacaaaagaaaaaagagatctattagcgatcacaccggcagcggcgcttggttcctgtcgatggaaactgggggatcccaaagaaaatgcagaagaatttgaagagatcatccgtattttaagaaagaatgacataggatattttatatatactggtggaaatgattctatggacaccgtatataaactgtctgtttactgtgaagaacataatattgatgacattaaggtaatgggagctccaaagacgatcgataatgatcttggagagactgaccattgccctggatttggttctgcagccaaatttatcgcgactgcgtttaccgagattgcgtgtgattgctttgtttatgatgtcccatccgtaacgatcgtagaagttatgggaagaaatgcaggatggttgacggcagcatctgcacttgcaaggattgaagggcgaaaagttcctcagttgatctatctttgcgagaaagcattcgatgaagatcaatttattaaagatgtaaatgaagcattaaaaaaagaaaataacatcattattgcggtaagtgaaggtgtaaaaactgctgacggaaattacgttggagaagaaacaaaatcaggaaaagaagatgtatttggacataaatatctttctggtgttggtaaatatctggaaggactggtaggagagaagattggatgtaaagtcagatctgtagaattaaacatccttcagagatgtgctggatatatgttaagtgagactgatatcatggaatcaagaaatcttggagcatttgcagctgtcagtgcgattcgcggaaagagtggaaaaatgtctgcagtgcgaagaatttcagatgatccatatcaggtagaaatcgtactttctgatctgtcaaagattgcgaattatgaaaagaaagttccgatggaatggatcaatgaagaagggaatgatattaaagacgaattactgacatatttaaaaccgttgatccaaggtgaagtacagattccatatgaaaatggaattccaaaacgatttattttataaaagacaagaaagaatcctgctgtgcaggattctttctatttaagttcatatggaatgtcatgtcttttgtttcttggttttacaggcttttttgacgattgtgagatgaaataatgattgatctctgcaccgataaaaagcatcatcatacaaaaatacaaccagaacaaagttaacaagatactggtcaatcctccgtacatagtactaaagaaagaaaaattatcaaaatacattgaaaagaaaaatgataatacaaaccatgcagcagaactaaaaaatgctccaggaaggatctgctttgttttgaaattttcactcggtaaaaaacgatacataatgataaaaacgaccataaatgtaaaaaatgcaaggaaaaaacggatcgttgcaaaaaatacatgtttattctcgaggactggttcaaagcgatataactgaatgagcagggaattaccaaataataaaagaatcagaccgaataatactgcgatcgcgaaaagtccaatataaatacttgagataaaacgcaaaacaaaatagtttctcttttcagaaatttcatgaatcgtattaagtccagtcatcaaggataagatccctttggatgcagaccacaataatgtaagaattgtgatcgacatatacgtagtagtaagttttccgtttaaagatcggatgatcgggactaccataccactgtactttggtggaagataggtgcgaaccagttcgatcatatcattcggtgtgatcggaaaatatcttgtaagactaagcaatacgatcataaatggaaaaaatgataggatcgtaaagaatgcagcctgcgcagaaaacgctgtaacgtggtctttctgagctttatcgatgacggatccaatcatagaaattaattttaacataatatcatacctcttaattgatacctcataatatcataatttgattgattatacaagcattctaaaagcaaaggaattgcgccaaaagagaaaaaatatctaaaacagacaaaaagacctattgcatagtaaagaaaattgtgatatagttcctaacggagtcaaaaaagaattataattatttaaaaaaataaataaattataaaataattcttaaatattctattgacaaagtgaagataccttgttaaaatgtagacataagttaacaggagattacgaggaggattgttactggtagtgcaggctaaaccaacttattgaatttcacagaagggaagtttataagtgaggtttatttttttgtgaatgcgcaacaggaagtcttttcgttagagaagtatgaggtaaagttgtgcagattacaaaaattgtaaatgataacattgtaatttcagaggacaagaatcataaagaagttgtactgatgggaaagggccttggctttcaaaagcacaagggagatgagattaagttgagtcagattgagaagacttatgtcatgaaagatcatggtatgacacagcgttttcaggagatgttaactgatattccgatcgagagagtgaagatttgtaataagatcattcagtatgcgaaggatacattacagaagaatattaatgataatatatatgtttcacttacagaccacatcaattttgcgattgagagagttgagatgggagtaccattccagaatccatttttatgggagatcaagaagttttattatcaggaatatctgatcgggaaagtagcgatcggtatgatagagaaagaactgaaggttacgcttccacaggatgaagcggcgttcattgcattgcatattgtgaatgcggaacttgatctggacatgacagagatggtttctatgacgaagcttgtgaatgatattttgaagatcgtggataaacattttggagagcagattgataaggagtctgttttctatgagagatttatcacgcatctgaagttctttgcacaaagagtttatattggcaaagaagtgaaaagtgatgatacagaatttcaggagatcataaggaataagtatcacgaatgtattgaatgcgtagatgagatcaaagactacgtgaagaagacttgcaatcatgatattacagatgaagaacttatgtatttaaccgtacatatcaagcgagttacgacaagataaaagtttatattgttgatcaggattgttactggtaatgcaggctaaacttgatttgaatcatggattttccagagggtccaggtttctttgtgaaagtatttttgcagggggatttggatggtggagatttacggatttgaatcaggtttttttatttataagaattttcttataatatatataattaattagcttatgaaaatatagaaaaggaggaataaaaaatggtaggaattattcttgctacacatggtgatttcgccaagggtatcttacagtccgggtccatgatttttggtgaccagccaaatgttgcggcttgtacattacagccaagtatgggaccagaagacatcaaaaaacagatggaagatgccattgccggattcgaaaaccaggatgaagtgctgattatggttgatttatggggtggaactccatttaatcaggctaacggattaattgccggacatgaagataaatgggcaatcgttgctggattaaatcttccaatgttgatcgatgcatacgcatctcgtatgatgatggacacagcacatgaagttgcagctcagatttccggaagtggaaaagaaggtgtgagaatctatccagaatctctagaacctaagaaagaagaagctgcaccagctgctgtggcagcacctcagggagcgatcccagaaggaacagtacttggagacggtcacatcaagatcggtcttactcgtatcgacacacgtttattacatggacaggtggctacaacatggacaaagatggtaaatccagaccgtatcattgttgtatctgatgccgtatcaaaagatgatcttcgtaagagaatgatcattgaggcagcacctccaggaataaaagcacacgttatcccaatctggaagatgatcgaagtatcaaaagatccaagatttggtgagacaaaagcaatgcttctgtttgaaacacctcaggatgtattaaaagcaatcgaaggtggagttgacatcaaagaggttaacttaggatcacttgcacattcaacaggtaaagtagtagtaacaaaagctgttgcgatgggtaaagaagatgtagaaactttcgagaaactgatcgacaaaggtgttacatttaatgtacgtaaagtaccaagcgattctccagaaaacatgggtgaaatgcttaagaaagcgaaagcagaacttaaataatcaatttagaaaaatatataggaggaattatcatgtcagttatttcaatggtattagttgttatcgttgcattcctggctggtatggaaggtgttttggatgaattccagttccatcagccattagtagcttgtacattaatcggacttgtaaccggacagcttgttccttgcatcatccttggaggtagtcttcagatgatcgctttaggatgggctaacatcggtgcagccgttgccccagatgctgcattagcagccgttgcatctgcaatcattcttgttcagggtggacagggaagagctggtgttgatactgccatcgcagtagcaatcccattagcagtagcaggattattcttaacaatgatcgttcgtacactttccgttatctgtgttcatcagatggatgcagctgctgcaaaaggtagcttcaaaggtgtagaagcatggcatatcattgcagtttgtttacagggtatccgtatcgcgatcccagcagcagcattacttgcaattccatcatctgccgtagctgcagcattaaatagtatgccagcatggttaacagatggtatgtccatcggtggtggtatggtcgtagccgtaggttacgcaatggttatcaacatgatggctacaaaagaagtatggcctttcttcgcaattggtttctgtctggctgctgtttcagacttaacactgatcgcattaggtgttatcgctgtatctatggcactgatctacctgaaactgtctgagaatgcaggatctggtaacggtggaagcaatactggtgacccattaggcgatattttaaatgattattgattaagaaggaggtaagaaaaatggcagagaaaaaagttcaattaagtaaaaaagatagattgtctgtagcattacgttctactttccttcagggttcttggaactatgaacgtatgcagaatggtggttggtgtttcgcaatgatcccagctatcaagaaattatatacaacaaaagaagatcagatcgcagcattaaaacgtcatctggaattcttcaatacacatccatatgttgcatctccagttatcggtgttacactggctctggaagaagataaagcaaatggtgcacctgtagaagacagtgcgatccaaggtgttaaagtcggaatgatgggacctttagctggtgttggtgatccagtattctggttcacagcaagacctatccttggagctttaggagcttcccttgcaatgggtggaagtatccttggaccaatcttattcttcgtattatggaatgtaattcgttgggcattcatgtggtatacacaggaatttggttacaatgtaggaacaaagatcacagaagacttatcaggtggattacttcagaaagtaacaaaaggagcatctatccttggtatgttcgtccttggtgccttgatcgaacgttgggtaagtatcaactttacacctgtagtatctaaggttacattaagtaaaggagcttacatcgattgggctaaacttccagcaggagcagaaggaatcaaaacagcattaacacagcaggcatccggtatggcacttgatccaacaaaagttacaactcttcaggataacttaaactcattgattcctggatttgtaccattactgctaacactgttatgcatgtggttattaaagaaaaacgtttctccaatcatcatcatcatcgcattatttattattggtattggtggacacgttatcggattattataagagatgatctagcacatatacaaaaggcccggaagtccgggctttttgcttatataagaagaatataaaaaatatatcggtaagaatgaacgaaaagtcatcttgtataagcaaagaaaattgtatagaataaataaagaagaacctacagaatcggaggaaagcttatggcacaatcaattaatacaagagttgatgttgttgtggaagcaacatcgtatcagggacttacaaactatggaaagatcatggttggagacaaaggatttgaattctttaatacaagaaatgtcaatgattatattcagattccatgggaagaagttgattatgtgatcgcatctgtgatgtttaaaggaaagaaaatcccacgttatgcgatccagacaaagaaaaatggaacattttcattttcatcaaaagaacctaagaaagtgttgcgtgcgatcaaccagtatataccatccgaacgtctggtgcgttctttaagcttttttgatgtattgaaacgtaattttatgccatcaaagaagaatgcgaagattaaaaaataaatgtaatttttggagttacaaggtaaagaaggagaagatggctatgggacatattttaagaatgaatccagtttttaaagaaatgatctggggtggaacaaaattaaaagatatttatggatatgagattccgagtgatcacacaggagagtgttgggcaatttctgcacataagaatggagattgtacgatcgcagatggagaatataaaggaaaaacattatcctggttatttgaaaaccacagagaattatttggaaatatcgaaggagaccagttcccattacttgtaaagatcattgacgcgaaaaatgacctgtctgtacaggtgcatccagacgatgtgtatgcgaaggaacatgagaattctttaggaaagacagaatgttggtttgttcttcaagcggatgaagaaacaaagatggtcatgggacaccatgcaaagacaaaagatgaattcgtcaaagcgatcgagaatgatgattatgacaatctgttaaattcattcaagatcaaagcaggagatttcttctatattccatctggaacattacatgcgatctgcagcggatcgctgatctatgaagcacaacagtcttctgatattacatatcgtgtttatgattatcatagaaaagatgcggatggaaatgaaaggcagcttcatgtacagcaatctattgatgtgacaaatgtaccagcagatattgatcagaacaaagaatttccgcagacaattcttgagaatggtacaaagacaagatatgttgacagtgaattctttaaagtggatcgttatcagttgaatggaaaaaatgtgatcaagaatgacgaaccatttatgatggtaagcatcatagagggaacaggaatttttgaaggaaatgaagtaaagaaaggtgatcattttgtaatctgttccgatcagaaagaagttacttttgatggagatatggaagtcatgatttccacattatgatcatgaccataatagataaagaaggattataagaatatatagaataaggaagttttatatgaaggaaacaggaaaggtatttggcgtcttgcaaagagtcggacgtgcatttatgcttccgatcgctgttttgccagttgcaggtcttttgcttggaattggacgatctttgacaaatgaaacaatgcttcgggcctatcatctgatgaagatcatgggtccggggactattttgtatggagtaattaaagttggaagcgattgtggaagtattatatttgacaatcttccgttgatatttgcaatgggagtttcaattgggatggcaaaggcagagaaagcggtagcagcattatcaggggcattgtcttttttcgttatgcacgaagctatttcatcgatgttatcattgtatggtgatacatatacaatgcatgtgggagcaacggatcagattcttggaataacatcactgcagttaggtgtatttggaggaattcttgtcggacttggtgtcgggtatcttcataaccgtttttataaaataaaacttccagaagttttatcgttttttggtgggacaagggcagtgccggttatttgtaccattgtatatgttggagttggaatattaatgttctttatctggcctccgatccagaatctgatgtattccattggaggaattgtgagagcttcaggctatttagggacgtttatttatggagtgatggaacgtgcattgatcccatttggacttcatcatgtattttatctcccgttctggcagacatcgttaggtggaacgatggaagttgctgggaaaatgatcgatggggcacaaaatatcttttttgctcaattagcagatccagcaacaacacattttaatgtggaagcaacaagatttatggcaggaaaattcccattgatgatctttggattgccaggagcggcatttgcaatttaccgttgtgccagacctgaacagagaaaagttgtcggtggacttatgatttcagcagcattaacatcaatgctcacaggaattacggaaccgttggaatttacatttttatttattgcacctggattatatggaatacattgtgtttttgcaggacttgcatatatgatgatgcatgtattgaagattacagttggattaacattttctggagggcttatcgatctgttcttttttggaatcatgcaaggacaagaaaaaacaaactggatgatggtcattccactgggaattgtttatttcatagtgtattatttcttattccattttctgatcttgaaatttgatatcaaaacaccaggaagggaagaagaaccagcacaagaatatgaagaagagccagaatatgaatacagagaagatttttcagaagaattattagcaaagatcgcagcgggacttggaggcaaaaagaatatcggtgatattgactgttgtgttacaagacttcgatgtggactgaaagatataagtctggtggatgatgccatgatcaaagaaacaggatcaaggggaattttgaaacgaggaaacagcattcagatcatttatggtccatatgtaacggtgctaaaatcagaactggaagattatttaaggacaagacgagcaaagaaagaaatcaaacaattactaaaagaaaatacacattccaaagataaaatgcaacaggaaagtatcgcctgtccgatcaaaggatgcgtgattgaactagaagaagttggagatgaggcattttctggtggaatgttaggggaaggctttgcagttaaaccagaagaaggaaaactatatgcaccagtagatgggatcatcgcagcagtgtttaggacaaaacatgcccttgctatggaatccaaagatggagcagaagttttgatacatcttgggcttgatacagtaaagcgaggtggaaaaggcttctatatgaaagtagaagctggtcagaaagtaaaaaaaggagagctcatctgtgagttcgacttagaagatatgagagtagatggatatgttatgacgactccggtagttatcagtaataatgcggaatacgcaagtatttcattgaaacatattggagagtgtaacgtaggggaagaaatactgaccctttataaataggtaactataaaattaaatatagatacaattcttaaacttaaaaagaaagaatgtatttatgatcgatatcagatcataagatgcattctttctttttacttgcagacaaaaaactaccgtagtaaaataaattcaatatgctaacgaaagagaaggtttgaaaagtatgaaaaaagaacagatcaaaggatcattatcattatttttagctgcgatcatatggggcgctgcatttgttgcacaaagtgttggaatggattatgttggaccatttacatttaattgtgttcgtacattgatcggaggcattgtattgattccgtgtattgcgtttctaaacagaggaaaagtaaggaagaaaacaaacttcacggagaaaaagagattgctattaggcggaatctgttgcggagtcgcattagctacaggaagcaccttgcagcaatttggaatcatgtatacaactgtaggaaaagcaggatttattacagcattttatattatcattgttccaattttgggattatttttaggaaaaaagtgcggattatccgtctggatcagcgttgtgatcgcacttgcaggactttattttttatgcattacggacggattttcgattggaaaaggggatatctatgtatttttaggtgcaattgcattttcgattcatattttagtgatcgattattttacacaatttaatgatggagtgaaaatgtcatgtattcagttttttatctgcgggattctttgttttgttccaatgatgctttttgaacatccggagattagcatgatcttacttgcatggaaaccaatcttatatgcaggagtgatgtcatgtggagttgcttatacattacagatcgtggggcagaagaatatgaatcctacggtagcatcgttgatccttagtctggaatctgtgacctctgtgatcgctggatttttggttctgcatcagaatttgagccagagagaattgatagggtgtgggttaatgtttatagcgatcgtattggcacaacttccacagaaaatttaattgacaaatgccataagaatgttatagaataataacgttaaaggcattgatggtgcacagtaagaaaccaagtgtttccgaatttcacaccgtagctgtatctctgaatgcgatgcaacaatcattttcatatcatgtatcagtaggagataacggagtctgcccgttacgcagagacttaagtgcttatggtaattaagaagaagtttaacgataccataggaattagggtggtaccgcgagtatatattaagaactcgtccctttgcggacgggttctttttcttttgcctgaatacagaagaaaaagtaacctgatccgagaatatagaaaagatcaataaaggagaactaagcagatgaaagagagattagaggcaatcaagaaagctgccttggagaaaatcgagcaagcagatgcaatggatagtttaaatgatatccgtgtatctgtactgggtaaaaaaggtgaattaactcaggtattaaaaggaatgaaggacgtagccaaagaagaacgtccgatcattggacagatggtcaatgataccagagcagtcatcgaagaagcattagaaaaagagatgacattattaaagaaaaaagttcgtgaagaaaagatgaaacgtgaagtcatcgatgttacattacctggaaaaactcatgaaaaaggacatcgtcatccaaaccagatcgcgctggaagatttagagagagtatttatcggtatgggatacgaagttgtcgaaggaccagaagtagaatacgataaatacaactttgaaatgttaaatattcctgcaaatcatcctgcaaaagatgaacaggatacattctatatcaacaaagatatcgtgttaagaacacagacatctcctgtacaggctcgtatcatggaaacaggacagatgccaattcgtatgatcgcacctggacgagtattccgttctgacgaagtagatgcaacacattctccatctttccatcaggtagaaggattagttgtagataaaggaatcacatttgcagacttaaaaggaacattagaacagtttgcaaaagaattcttcggaccagataccaaagtaaaattccgtccacatcatttcccatttacagagccaagtgcggaagtagacgtgacatgtttcaaatgtggtggaaaaggatgccgtatgtgtaaaggaagcggatggatcgagatcttaggatgtggaatggttcacccacacgtgcttgaaatgtgcggaatcgacccagaagtatattcaggatttgcatttggaatcggtttagagcgtgtcgcattattaaaatacgagatcgacgatatgcgtctgttatacgaaaacgataagagattcttatcacagttctaagagaaacgataagaatatttcgaatagagaagatagaataaaggagaataaaagtaatggatacaccaatttcatggatcaaagcttatgtgcctgatcttgattgcacaccacaggaatatgcagataaaatgacattatctggttccaacatggaaagtgtcacatatttagataaaaacttagaaaagatcgtagtcggaaagatcgagaagatcgaaaaacatccagacgcagacaaactgatcatctgtcaggtgaatgttggagatgaaacagttcagatcgtaacaggagcaccaaacgtatcagaaggagacttagtaccagttgtcttagacggtggacgagttgccggaggacatgacggtggaaagaacccagaagacggaattaagattaaaaaaggaaaacttcgtggagtagaatcttttggtatgatgtgttctattgaagaacttggaagttccagagacatgtacccagaagcaccggaatatggaatctacattttcaataaagacgtaaaaccaggagatgatgcagttgaagctttaggacttcgcgatgcagttgtcgaattcgagatcacatcaaaccgtgtagactgcttcagcatgatcggtatggcaagagaagcagccgctacatttaagaaagacttcttcccaccagttgtcacaaagactggaaatgatgaagatgtcaatgattacatcaaagtaagagtcgaagacgaagatctttgcccaagatacacagcaagagttgtaaagaatatcaaattagcaccatcaccagaatggatgcagagaagattagctgcgatgggaatccgtccgatcaataacctggttgacatcacaaactacgtgatggaagaattcggacagccgatgcatgcatacgatcttgatacgatcgcaaacaaagagatcgtcgtacgtcgtgcaaaagcgggagataaattcactacattagatggtgaagaaagaacaatggatgaaaatgtcttaatgatctgcgatggagaaaaagaaatcggtatcgcaggtatcatgggtggagaaaactccatggtaacagatgatatcaagacattattatttgaagcagcatgctttgatggaacaaatatccgactttcttctaagagaatcggtttaagaaccgatgcatctggtaaattcgaaaaaggattagacccagaaaatgcaatggcagcgatggatcgtgcatgccagctgatcgaagaattaggagcaggagaagttgttggaggagccgttgatgtttatccaaatccagtcaaacagatccgccttccattagaagtagacaagatgaatgcccttcttggaacaaatgtatccaaagaagaagtcttagaatatttcggaagaatcgaccttggatatgatgaagcaacaaatgaagtcatcgtaccatccttccgtcaggatcttcaccgtatggcagaccttgcagaagaagttgcaagattctacggatatgataacatcccagttacattaccaaacggagaatccacagctggtaagaaaccattcaagatccgtgttgaagatgtctgcagaaatgtagcagaacagaacggattctgtggtggaatgacatattccttcgaaagtccaaaagtattcgataaattattattagctgaagatgcaaaagaacgtcaggcaatcgagatttcaaacccattaggagaagacttcagtatcatgagaacagtttccttaaacggaatgttaacatctctgtctacaaacttagcacacagaaataaaaatgtaagattatatgaatttggaaatatctacattccaaaagcattaccattaacagaattaccagatgaaagaatgcagatgacacttggaatgtacggagaatgcgatttcttcacattaaagggtgttgtagaagatatgcttgattccttaggattaggtggaagatctgaatatgcaccaacaggtgaacatccattcttacacccaggaagagctgcagatgtgacgatcgatggagaaaagatcgcctatatcggacagatccatccagaagttatggataactataacatgaaaggtgaggtctatgtagcagtcatcgacatgccaacattagtaccaaaagcaaccttcgaccgtaaatacgaaggagtagccaaattccctgcaatgaaacgtgacttaagtatggttatgaagaaagacatcttcgttggacagcttgagaagatcttcaaagataaaggtggaaaacttctcgaatcctacgaattattcgatgtctacgaaggagaccagattgaaaaaggatataaatccgtagcatactccttaacattcagagcaaaagaccgtacgttagaagacgcagaagtatctaagatcgttgagaagattcttgatgaattgaagaaattaggcgttgaattacgtgcttaattgtgattgaaaataaaataaagtgagaattaaaatcctctggcagataatagtgtcaggggatttttgtttatcagaaagaagcaatatgtaaaggtgttgaaaaaattattgtttttcaataatttttatgctacaataatcttgaaattatcgaaaaacaataattggaggtagataggatgaaatcaaacataaataaactaatcctgatcgaagtcatcgcaggaatcctttttgcattcatagcaagcaaaatcctgcatatgacagcagcactacagatcatgtacttaccatttgaactcataggaaaagggctaagatttctatccctaagttcagcaataggaaatgtcatcgcgatcatcatatacgcagccatttcaatgataccagcaatctatatcatctatcagagaaaaagaggaagaacacagaaagaagacatattacttgttgcattcacagggctattattttattccctgtatatgttcatcaatccaggactcatgtatcagaaaatgccagacattttttcaatggaccaaagcagtttgattgtaatgaaaattatttacgcattcatcatttacagcgtcctgatcatgtggttgatcatgaaagcgatccgttttcttggagatgacagccagaagaattggaaaagccgtttgtattttgggatgaaaggactgattgctgcactagtcagttattacacgcttttgatcacatatgcaaagacatttgaactgcttcataagagcgaaaataaactgcaaaatgtatcttcgatagtatggtttaaatcagtattacagttattaccaatcattatgacaatcctgctatttatcaacatcattcatgtagtaaaagcaatcgaagatcataaggaagagcagcagatgatgacagtggcaagactcgcaagtgtcgcaaaggttaccgcagtggttacagtcatatcagattttatcctgaatttttatcagtttttattaggagcaaccttacagaatgtaaatgttacgtttgcaccagatgtatccatggaaccattgatcatagcatttggagcattgatcttccatgaatacttcaagcggactaaacagttaaaagaagaaaatgaccagtttatatagaaggaatgatagttatggcaattaaaatacatttggatgacatcttaaaagaacgaaacatgacatccaaagaattatgtaaaaaagtccatattacagaagcaaacctgtcaatcttaagaagtggcaaggcaaagggagtgcgtttctcaacgatcaataagatctgttattatcttgagtgcgatgtcggggatatcttgaaatttgacgggagattggaggaagaagatgagtaggggaatcagaaaaacaggagtattggcaatggttgtgatgctggcagcaactctatcaggatgccgccttgcaaaaaaagacgaggatgaaacagtaaagaaaacattatatggtgcttatgcagttgtaggaaagagtctggatgatccagacattccagatccagagatggaaggaacaaccgttgggcagaaagataaaaaaggatttgttcattttaaaaagatcaagggatatttcttttttcataaatacgatcagaaagaaaatacgatcagcatggatggtgatccacagttgactcatttttcaggcggctctaatatgaaagatggcgagatccaaaaagataaatggcaaaagacaggccagtcatgtaaggcaacaatttatgttcaggaaacaaaaggaatcacaaaagtgcagattggaagtgtatataaaagagcagatggtacattttatctggaaccttcaggaaggtcttctgtgcaggatctttgtaaaacaggagggtttggaatcagccaatctttttctgtggatacagaagaaggaaagatgacataccgtgtggactttaaagcagaccgtgcagtcaaaaagattcagatcatcgaaatgaacaaagatgatgtcaagatcaaaaaaacagcctatatttcacctgaaataaaacaataccagatgcaaaaagatacagcatatgttattataaatgaacagctgatcggtatgaaaggtcaaacgatcaacagacagaagatacattcagcaaagaagaatttcacatataaatggaagcagcttggagatgatggagtattgacaccgacagacttgaagtttaaaaagtaaaatcaggaggataaaattgaaagatgaaagataaaagagaatcatttaacagcaggtggggatttatcctcgcctgcattggttcggcagttggcatgggaaatatatggatgtttccgacaagggtatctttgtatgggggaggttcttttttgatcccgtattttatctttgtcgttgtgatcgcatctactggtgtgatcggagagatgagttttggacgtgcggcaaggtctggaccgattgatgcatttgggatggtctgtgagaagaaaggaaagagaaaagttggggaagggttaggaatgatcccagttcttggttctcttgcgatggcgatcggatatacagttgtgatggggtggatcttaaaatatgctgttggaactttcacaggggcaacacttgcaccaaagacgatcgaagaatttggcggacgttttggaacaatggcatctgcatttggaaataacatctggcagattttagctttgatcttatgcatgtgtattttaatctttggtgtaggagcagggatcgagaaagccaataagattttaatgccaattttctttacactgtttgtgatccttggaatctacgtggcattccaaccaggggcagcagcgggatatcaatatattttcagagtcgataaggcggccatcttagatccaaagacatggatctttgcactaggacaggccttcttttccttatccgtcgcaggaaatggaacattgatctatggatcgtatttatccgatgaagaagacatcccatcatctgcggcaagagttgcattttttgatacggttgctgcgatgcttgcagcactcgtgatcatcccagctatggcaacaactggagcaacactggatcaaggaggaccggggctgttatttatctatcttccaaacctgatcagctccatgccaggaagtacgatcatcgcgatcatctttttcgttgcagtgctttttgcgggaatgacatcactgatcaatctctacgaagcaccgatcgcaaccgtacaggaaaagcttcacgtaggaagaaagaccgcctgcgtgattatcgcagtgattggcgtgatcgtctccttattgatccagggcatcgtatctgactggatggatatcctatctatttacatctgcccactaggagcaggactcgcaggaatcatgttcttctggatcgccggaaagaaatatgtagaaacacaggtaaacaaaggaagagaaacaaaatttacaaagatgtattgtccaatctgcaaatatatttatgtaccgatctgtattttggtattggtgcttgggattgcgttaggcggaattgggtaatgaatgaaggatcgtagttaaggtatatcttggctgcgattttttcttatatgaaagcaaacaaattaagttccaagaaatcatacgaaattgcaaggaaaggatatttacatttaagaagatttttgttatgatataactatcaaagtagaagtattattgaatgcgatatgactataaatatagaataaataacaaagataaaggggatttagctatggaattaaaagaattaacaagtgcagaacaggttgtgatgaaatgtatctgggattatggaaaggatatgccattacagcagttgattgaaaatctaaagcaagattacggaaaagattataaaagaacaacgatccgtacatttgtccttcatttagaagagaaaggatatgtgacaacatatcagattgggaaatattcttatattaattatctgatcgaagagcaggattataaagaacaggaattggaaaagacaaagaatttctggtacaaagaatctggatttgatctggtgaagacattatataaaggaaaattaaatgaggggaaactaaagaaactcaaaaagttgttagaagaaatcgatgattgacaggagaagatatgatagacataagagagatattggttaggatatttagtgcgatatttttatccatgtgcactggaagctgtatgtttgttttctggatggcactaagaaagttttttgcagataagattcgtccaaaagtctatgatttgatattaaagatcattctaattgcttactatgttccggcaggatatctgttggtaaatattttttttgataatgggtatgtatttgattttacaggtactatcatcaaggctttttatgctatatcgttgttctggctggctggagcaattgcaacagttctgaagtttggagaacgaacttttcgaattagaagagaaaaagaaagatgctttccatgcaagatgtatgtgcaaaagatctttgaagattgtaaaagagagcttggaattcgcagatcaatagaagtattacaaggatatcgcattcagattccaatgacagcaggaatattaaaaccatgtgtgtttttacctgtggaagatatggaagaagaacaattaaaaacgtgtatttaccatgaactcacacattataagaagcacgatatattttggaattatatagcatgtctgatggtatgtattcactggtattgcccatggatcagaactgtatttcgtaagaacgatgaatggagcgaggtgatctgtgatctatcagcgattggttatgtaggatcagcgaagcgttattttacaacgatttttgagatgagtcagaaaagtcagggaatcaaagcatatcgggcagcatgtctgtttgaaagccgagatagtttagaacaaagaatctactatgcaatgatgtatcgaaaacaaaagaagataaaatatgctgcggtgattgcaatgaccgtgatattttgtggaatgagtgtaaccagtattttggctgcaagtaagggatatcaaaaggcgtatacaaaatgggtacaagaaacggaagtagaaatagaagaaccagatgatgaggaagaggagagaatatcgtatgaagaaaaaacgggagttttgggaaatgataagagtgaaacgataaagaagataaattttaaaaagatggatgcgatgacattggagacttatgtaaaggcaggaaaaaggcttcgatataaaggattaactccgaaacgaaatgaaaatatagaaatttttataacaagtcaaaaaaattttaaggggataaaagttgggattattgattcacagaataggattagatacatacaggacagagggagagatttagttgaacatagatttaagatagaaaaagaggggaaatatgatgtgtttattgaaatggaggataagaaagatgtaaaaattgttggaatgattaatattgatgatgattaaagagatggaggaataggaggagaaaacgatgataaaatatataaaaataatggtaacagtatttacacttttaattagttgttcagtgacaaatatatttgcaagtgatacgaatgatgttatagaagaaaagatagatatatcagaaaatattattgatgaagttggagaggaagactttgaactgttgtctaattcgataacagttaattggacagtgaaaaatggagttagaaagaaaactaaagaattttataaaaagaaaggaagtagtatcaatattaggttacagatagctccaaaaacaaaaagtgtcaaagtaggatatttagatgcagataaagtaaaacattataaaactgttaaagcagaaatcaatcacaattttataatacaaaaaacaggatatatagaggtgtttgttgaaaatagtagtggaaaaactgtaacggcaagtggaacttatactaagtaatattttatttataaatgtattttataagaggtgatgcaatatgaacaattaaaaaatccatgtaatacgaatggctgccacctacctatctgtaatatatacagatagctgtatcacatggatacaataatgatagcagaaaatgagggaaaataaaagaatgaaaggaaaaagtttatgaaattaaaacaatttgtatgtaaagcagcaagtattgcaatgtgtgctatgattattggaacaactgtagtttcagtgaatgttaaggcagatacgaaagcaacagaaagtacagtagcactagatacacatgatgacgatggtgttgcgggtattttggaacaagatgattttgatacactagaagaatatcagaaatatttagagacacacccaaaagtacagacacggcaaagtcgtgtatcagcgaataaaaatgtaaaagcagcagctactttaagatataaaattaaaggattaacaaatacagctgcaattcaaaaaacatatattggatctacatatatttatgtgattcagagaattggctcagactcacgtttatcaagatgtttgattaatgggtcaacagctacatatcaagatcatatgacattaaaaaactttggtcatggacagactttggaatggtttgaacataattctaaagcatatttctgggttacatgtaaagcaaatgaagcgtataaatttaaatggggaactcaaattggaagaatacaatataaagctaaaggaagtgtagattatacagaaatcccaagattttctcatatgagttatgcaaataaaagtgggacatcgattggagaagtgaaacgtgtagatgcagcattgtctagtgataggaaaaaagtatttttctgggtaatggataatacaggagaaattcaatatagtttttataatgcggaaaaattaaatgctgaattggataaaaaagaatctgaagaatctaaatttgttccatgtacatcaagtgcagtaaaatcagcttgttatggatcgtttagacaatctggaagtaatcgtgtattaccgaatgattcatgtcagggattagaattttctgatggagattctatttatattattggaggtgctgccggacaaaaaccgggaatagcaaagttaacaggaagtggatcaagttataaatattcttgccttgttacagctacacataataattttggaggtaatgcggaatctgaaggaattcaattaaagggagattacgtatatttcgggattagtgataaacaaagtagcgataaagcctgtatttattctattccaaaaagtgcgttttaatttaagtctggctatgttaaaatatataatataaacattaataaattaaaattataaggaggtagcaagatggtaagaaaacgtatggtatcaacagtcatgagcttaatgatggcagcagcagtactgacgacagttccagtgactaacaatgtaaaggcagcagataaagagataacaagtggggattatacttatgtgaaagaaagcaatggaaagacttcctatgcagtgcttacaagctatagaggaagtgagacaaatcttgtcattccagaagaactggatggattacaggtaaaagcaatttcacagggatttgaaaaaaatctgaaaataaaaagtattatattatcaaaaaatattgcaccagcaaaagaaacacacagagatttggaagtgctaaatgaaattgaaacattggaagagattcgtgtagcaaaagataatctgtcttatcaggcacaagatggagttttatatagcaaagataagaaacaattgtttagctatccaaaatctaaaaagtccgaaacatataacatgcctgcttctgtaaaaaaagtagaagaattcaatgccctaataaatcttaaatatttaaagaatcttacattatcaaagaatttatcagtaacaccaagctgtaatgacagtagtattgaatctgtaacaattccgggccagataggcggtattgatgaaagcagttttgaaaattgcaacaaattaaataaagttacaattacaaaaggtctgagatttattaatgattatgcattttttgaatgtaaagcattaaaagaaatcaaactgccagaaggacttcaaagtattggagtaggagtattttatagaacaggaattaaacagctgacaatccctggatctgttgtaaaaattgatgtaattgacaagagtataaaattaagtaaaccatcttatttgaagaaattcaaaagagactcaggtgctatttattacgaagcaagagccacaatcaaagcatctggcaaaaaagctgtcacatacaaagcatccagaattacaaagattaaagcaaaaacaagcaaagtaacgatccaaaaaggaaagacaacaaaactacagactagagtatacatttccaagaaactgaaaaaaggatacttagatccagagatcttaaaattcacaacatccaataaaaaagtagtgaaagtatcctcaaaaggaacgatcaaaggcttgaagaaaggaaaagcaacggtcacagtaaaacttcgtacaacaggaaagacatataaagtgaacgtgaaagtaaaataggaaacaataaagtaaagatacatgggtagaacaggacattccggcgaaagcagggatgtcctgtgttttcttatgcagcattccttgttatttgcaatatcaaatggtagaattaggaatattcaaagtgaatcaatctgtaatatggaatggaaaacaatccgatacaacaaaggagaaacgaaacaatcatgccaggatacattttacatttaactgctgcccagatgtttctaaagacacaaaaaggacagaaatttttaaagacaaaacaagataaaaataattttctgatcggaaatcttctgccagatacaacaaagatcaaagcaagatcccatttcagagatccaaaatatcacgaccgcatgatagaatacccggaaacaagctggtttatcaagaaatataagcatcttctatcaaacagcagtgtggtcggatatctctttcatctctacattgatcgaagattttttaaagactatatgccaaggatcgtagagtttcgaaatgtacaagatgagagagaagaaagaagagatatggtaaaagatgtcttattaaaacggacaggacaaagattatcaaagtgggattttttctcagagaaatactactatggggactacacaaagatgaacatgtaccttgtaaatcgttatcagattccgacaacacttgatcccaatatatcaaatcctgggatcaaagaagttgattatgaggatgtaaagcaggtgttaaaagaattaaaaacatatctgaaagtaccagaagatgcagtaaagaacgtgagagtttttgacgtggaagatcttcttttctttttggaaaacgcagtaaatgaattcaaaatataatatttggttatcctacaaacaaaggaaatttgttcattatataacaaaaaaagttgcaaatattacaaaaatatgacataataccatagaaataactttatggaggacaacatgatgaaaactgtaaaggaaattgtaaagagggaacgtcaaaagagaagaagacgtgtggggattatgatcgtattgatcgctttatgtgcagcagcaattttctttggaaccaaagcttatcacaattataaggaagaggaattcttcaaaagtgtgaaagaaaaagaaatcaaagtaactccaaaaagcataacgcacaaacagacagatatctttacacaaagttatcaaaaagaaacggatgatcagttgaaagcattaaagaaagacaaaaattatactttcaataagcccttgatcgtttggaatgcatatggaacatacacaacatctttgtactattatgcaaaaaatgatcgtgcatcttatgcagtatgtattgtagaagccagcgaagcaggtgcgagtccatacaaacgtacattgaaatctgtatctggaaagaaatatgtgacaacacatgaatatcagatcaaaggacttgttccaggagcgaagaataagatcacaatgcaattctttaatgaagatggaagagctgtcgggaaaacacatttctacgtgacagcaccgaaagatgatgtcattcctgcaattcttaagaagaatacagggacaagcaaagcaaagatgagcgagggtctgttttgtttgtttggacatgataaagcggatgtgtcaaacatctatctgtatgatgataatggagtgagcaggggaagaatgcctttgaacaaatatcgtacagaccgctttttatttatcaaaggacagttggtatattcttatgactataataaaattgcatttacgaattgtataggaaaagtgacaaggaccattgatattggaaattatcaatttcatcacgatttccgttatgacaagaaacacgataagatcatttgtctggtaaataatctggacaaagatacgattgaagatacgatcgtacaggtggatataaagacaggaaagacaagtatgctctttgactgtgaaaaaattctgccgttaatgagaaaattagcaatccagagaaaaggcggtagaaatacctatggaggaactgaactagactggatacacattaattcttttgattttcttgatgatggtaatagtttggtcttaagcagcagagaacaaagttcaatccttaagattaaaaatatttacacaaaaccagaattagactatgtgatccatcgtggaacaatctataatgggacagatattgccaaatatcagttaaaacgagaaggagacttcgttgcaaatgcaggacagcatatgatcactgtagaatatgacgattcccttccagaaggacaatattatttatatatgtttaataacaactatggaaaggcaacatctattccaactttcgactggagtatgtatccgaatgtaggaaactttaaaagtggaacttcttattactcaaaatttcttgtagatgagaagacaaggacttataaacttgcacagcaatttagtttgccttattcggcaatcgtaagcagtgtgcagcatttaggggggaatattccgtttagcagtggaatgagtaagatatttggagagtatgataaagatggaaaactgatcaagtcctttgaatatgaagcagataaatattcatatcgcgtgatgaagtatgaattttaagttgtaagttggccaactatagtctttcagtatatgataaaaattaaataagcaaccgaaaacgcagcggtggaattttgctcacattttgaacaaatcgcttatccgcccaatttcctacgagaactcgctctgaagttttgttttagacaaaagtctttgaagctcagacattcgtccaattgggctgcgaatttgttcaaaatatggcaaaattccaatgctgcgttttcggttgcttatttaatttttatcatatacctgaagtctggagtgtggacaattacaagattggacaatttaagtgagtgtgtatgttgaatgttatcggttctgtcggagtataagtatcaagaaaaaacaatcctcgacataatattacaaaaatagactaaatattacaaaaatattacaaaataataatcgaaagtattgacatactacatataagtgctataatacacacatactcgagttaacaaaattgtaacatttacaggagggacattatgataacgaggaaaatgagactgtcgatggcgatgcttacgattgccgcgagtgtgttgacgacaggaaatataaaagcagatgagaaagatacaacaaaagaaacaaatacagcaacggaaagtaaatatgcgaataaagcagttgcagatatttattctacaacaacattaaatatccgaaaaaagggtagtataaatgcaaagatcgtaggaaaaatgaaaaaaggtaacattgcaactgtgctgaagaaaggatctgaatggtcaaaagtaagatcaggaaatgttacaggatatgtaaaaaatcagtatcttgtatttggtgatgagattaagaactttgcgaaacaaaatgtgaagaaagtggcgaaagttcagacggaaacattaagagttcgtaagaaagcatctacggattcaaagattgttacattggtatctgaagatgacaaattaaaagtaaagaaacagacggatgactgggcaaaagttaaggtcgatggtcagacaggatatgtgtcaaaagattatgcaaaagtaacatactcttttggaaaagcgaaatccatgaagcagattcaggcagagcaagaagcgaaagaggcgaagaaaagagcagaagaagcagccagaagtaagtctgaaaatgaatcagtatccacaacatcaagcggtcatacttctgatgatggaacaacatctggaagtacaacaggttccgcacagacaacaaagaaagcttccgtatccgtgtcatctagtggttcatcagcaacaggaagcaggatcgcaagttatgcacagcagtttgtcggaaatccataccgatatggtggaaacagtttaactagcggaattgactgttctggatttacgcagcaggttatggcgaagtttggatacagtatcagtcgtacgagtagttcccagtctggcgatggaagagcagtatctacgagcaatttaagagcaggtgatctggtattctatggagatggtggaagcattgatcatgtggcactttatatcggcggtggtcaggtagtacatgcaagtaattccgcaccatatccgcgaggaggaattaagatttcaaacgtaaattatagaacaccgatctgtgcaagacgtatcataggatagctagaaaaattatcaatacagtatttatatggaaagagcgtaaaaggaagattcatgcagaatcattcttgtgcgctcttccttttttgatataccagacatgaaaataaaaaattatatttcctatattgacagaagaacatcatgtttatagaatgtaaaaaggtatattttggttaggaaaataaagatagaaaagagatgtaaaaagaaaaagatgaaacaaagacgatttacaaacaaaaagctgatcgccctcatgttaccactggcagttgatcagcttttaaattcgtttatgggtacggtagatacccttgtagtcagcaatttaggatcagcagcgatttctgctgtcagtctggtagattccattaatattctggtagttcaggcattttttgcactggcttcaggtggtacggttgtttgctctcattatcttggatgtgagaagaaagagagagcaacgaatgcagccaggcagttagtgtttattacattcgcaatgtcactggtcattgcaatcgcgtgtcatttattcagcaaccagcttcttggagtgatctttggacaggtggaaccagcggttatggacaatgcgaagaagtacttcttcttttcggccatgtcttatccatttatcgcattgtacgatgatggagcctgcattttaagagcacaggagaacagcaaacttccgatgcagatttcttttgttgcaaatggcattaatgttgcattgaatctgatatttgtatgggtattgcatttgggtgtagcaggttcttctgcagcgacgatgatcgccagagcatttgcaatggttgcggtgctttataaattgagaaatccgaagatgaagatacagcttagagactatttttcgattcgtccagaatgggaagagatcaaacgaatcttacatatcggagttccatcaggaattgaaaatggaatgttccaatttggaaagcttgcgatccagtcaacggtatctttgatgggaacggcggcgatcgcggcacagggaatgaccaatatcatcgagaacttgaatgggatcatgtcgatcggaatggggatcggattgatgacagtcgttggagaatgtcttggagcaggagaaaaagaagaagcagtctattatataaagaagatttccattgcagcagaagttgtattgatcgctacatgtcttttgatgtttgggcttacttatccgatcacatattttggaggcatggaaccagagagtgcaaaactttgtatattcatggtaacatgtatcacgatcgtaaaaccaatcgtgtggatcatggcatttattccaccatatggattccgagcggcaggagatgttagatttacaatgacgacctccatgctgtgcatgtggctttgcagagtcgtgcttgccatggtacttgcgagagtttttcatatgggaccgatcgcagtgtggatcggaatgtttacagactggacgatccgtggaattatttatacaatacgatttaaaaatagaaaatggcttgctcatcaggtgatctgatgttcgttgcggatgatgacggttcgtgttatactgaaatgtatttgaatgatcaagaaataatatagaagggatacaaataaaatgaaagtatcagattttacatttgatttaccagaagaattgatcgctcaggatccacttgaggacagatcaagttccagattattaacattagataaaaatacaggagagatcggacatgatgtcttccataatattgtaaattatttaaaaccgggagactgtcttgtattgaataacacaaaagtaattcctgcaagactgatcggagccaaagaagaaactggcggcaaggttgaagttttacttcttaagagaaaacaggacaatgtatgggaaactcttgtaaagccagggaaaaaagcacgtccgggagcaaggatttcttttggagatggaaaattagttggagaagtcattgatgttgttgatgaaggaaatcgtttggtgaagtttgaatatgaaggtatttttgaggaagtgttagacgaacttggacagatgccattaccaccatatatcacacatcaattaaaagacaagaatcgttatcagacagtttacgccaaatatgatggttcagctgcagcaccaactgctggacttcattttacaaaggaattattacagcagatcaaagacatgggagtcaacatcgcatatgtaacacttcatgttggacttggaacattccgtccagtaaaagttgatgatgtcttagaacatcatatgcattctgaattttatagaattgaagagaaagatgcagaacttatcaatgagacaaagaaaaacggtggaagagttatttctgttggaacaacaagtacaagaactttggaatctgttgcagaagaagatggaacccttcatgcaaagagtggatggacagatatcttcatttatccaggatacaaatttaaagtgatcgatggactgatcacaaacttccatctgccagaatctacattattaatgttagtttctgcactcgcaggaagagaacatattttaaatgcatataatatcgcagtaaaagaacgctacagattcttctctttcggggatgctatgttcattcatccataagaagaattcacgataaaaggatatcttagaaaggaggtacaatggtaaatttgatcgaaataggaaaaagtggaataaaagtaccattcttaggaatgggaacatgggcgatcggtggtggaagctggtggggagacaatgatgatgaactctctgtcaaaacgattcaaagggcgatcgatcttgggatcaaatggatcgacacagcgccaatttatggattatatcacagtgaagatgtggtgggaaaagcaatcaaaggaaaaagagagcagattatattatctacaaagtgtgcactggagtggagacatgaaacaccagtttttcataaagaagtcgatggaacgaaagtctatcgtgacctttcaaagaaaagtatcattgaggatttagatcatagtcttttaacacttggaacagactatattgatgtgttgtatacacactggcagacaacagataagaaactttatccgattgaagagacaatggatgcattgatgacacttaaaaaacagggcaagatcagagctattggtgcgtcaaatgttacagaagaagatatcagggaatattgtcaatatggacagcttgatgtgattcaggaaaaatacagtatcgtgacaagaaaagtggagaaagaattgttgccagtatgtaaggaacttggtgtgtcaatacaggcatattctccattggaacaaggtctgcttacaggtaagtttacaatgaatacaacatttccaaatggagatgtaagaaataacaatccatcttttcagccagagataagaaaaaaggtattggatatcttagaggactggaaaaaatatctcgaaaaatatgagtgttcatacagcaatctggtaattgcattgacttctcagatgatggatggtctgcatattcttggtggagcaaggaaaccgaagcagattgaagacaatgccaaggcattgggtgtgtctttggaagaggcagatattgttcagatgaaaaaagatatagaagcgttattgtaagatatgaaatggaggaaagcttatgaaacttgcacttattggaacaggaaagattattgaagatgcattgtttgcaatggaaccagtagaaacaattgagagaacagcgatttttgcaagaccacatagcagggataaggcagaaaaatttgcaaaacagtatgcgatcaaagaagtttacacagactatgaagaattacttgaaaagacagaagcagatactgtttacataggactgatcaacagtgctcattatccatatgcaaaacaggcattattggcaggaaagaatgtcatccttgagaagccatttactggattttatgaagaaacaaaggatttagagaagattgcaaatgacaagaaattatttatttttgaagcgatcacagtacttcacaacgaagtgttttatgagatgaaaaagaacctgaataaactggggaatatccgtatggcactttgtaattattctcagtactccagccgttacgatgcatatttagaaggagatatcacacattcttttgatcctgcatattatggaggttcattatatgatatcaacgtctataatattcattattgtgtaggattatttggagagccaaaggatgcgacatattatccaaatatcggaccaaatggaattgatacatcaggaacacttgtgatggaatatgatggatttagtgcggtttgtacaggaagtaaagattcagacagtccaggatacgtctgtgttcagggtgaaaaaggttttatgaaagtagattctaaaccaaacattgcttctgaattaaagacggtttatgcagatgaaaatatcaaagaaaaagtaaaagatgcagcaggagcgatggttcgtgcaacgatcacagaagattataaggctccagagcatcaccaccgcatgacacaggaatttacagattttgcaagagtcattgatgaaaaagattatgagacggcaaaagaatttttggatgagacagttgcggttgtgaaagtacttgagacagcacgaaagaaagctggaattgaattttagaattaaattaaatagaaggaagtaatctatgaaagtgatcattatcggtggcggagctgccggcatgatggctgcatatcaggcagcaaaatgtggaaacgatgtttccttatatgaaaaaaatgaaaaattaggaaagaagatttttatcacaggaaaaggacgctgtaatgtgacaaatgcctgtgagatcgaagagctgttagatcacgttgtaaccaacaaggaatttttatacagtggtttctattcttttaccaatgatgcaatgatggaattcttggaagaacttggatgccctctgaaagtggaacgaggaaatcgtgtattccctgtatctgatcattcttctgatgttattgcagcattacaaagaggtcttagaaaagaaaatgttgacatatatttcaatacaactgtcaaaaagattctgattgaagatggaattgtaacaggagtaagactggcatctggagacacagtgaaggcagataaagtcgttgttgcaacaggaggtatgtcctatcaggcaaccggatcgactggagatggatatgattttgcaagaaaagcaggacataaagtgacaaaacttacgcctgcacttgttccgtttgaaatcaaagaagattattgtaaacagttgatgggattatctttaagaaatgtcgcagtgacaatgactgcagatggcaagaagatttacgatgattttggagaaatgctctttacacactttggaatcagtggaccagtcgttttaagtgcaagtagttatattggaaaatatcagggcaaagaattaaaatttatcattgatctgaaaccagcacttaacaaagaacagttagatcacagagtattaaaggattttaataagacattaaacaaagattttgtaaattccttagatcatcttttgccgaagaagctgattcctgttatgatagagttatcaggaattccagagcataagaaggttaacgagatcacaaagaaggaaagagaacgatttgtttctttattaaagcatttagaacttacaattacaggagtgagtggatttaaagaagcgatcattacacaaggcggagttaacgtcaaagagatcgatccggggacgatggaatcaaagaagatcaaaggattatattttgcaggggaagtattagatcttgatgcggtcacaggtgggtttaaccttcagatcgcatggtcaacaggatatcttgcaggaatgaattaatatattaggaagcagatcaggaggaaaagataatgtatagtattgcgattgatggaccagcaggagcaggaaaaagcacgattgcaaaaacaattgcaaagaaattagaatttatttatgtggatacaggagcaatgtaccgtgcgatggctctttatttcatcagacatgagatcgatccaaaggatgaagaggcaatcaacaaagcatgtccagatattcatgtaagtatcaactatgaagatggagtgcagcaggtgttattaaacggggaaaatgtaaatggactgatccgtacagaggaagttggaaatatggcttcgaagacatctgcatataaaatggtaagagcaacactattagatcttcagagagatcttgccaagacggctaatatcttaatggatggaagagatatcggaacaaacgtactgccaaatgccgatttaaagatttatttaactgcatcatctaaagtaagagccgagcgccgctacaaagaattggtagaaaaaggtgtagaggctgatttcgataagattgaggaagatatcattatccgtgaccgtcaggatatggaacgtgagatcgcaccgctaaaacaggcagaagatgcagtgctggttgattcttctgatatgacgatcgaagaagttgttgatgcgatcgttgcagaatttgaaaaagtaaaataataaaaagtttatttgcaagcagtgaggataaagatggaagttattttagcaaaaacagcagggttttgttttggcgtgaagcgtgctgttgacactgtatataaagaagcaggaaagaaaaatgtatacacatacgggccgatcattcacaattcagaggttgttaatgatctgaagaaaaagggcgtggaagtgatcaattccagagaagaattagaagctttggaagaaggaacggttatcatacgttcccatggagttgcgagagaaatttatgatctgatccatgaaaaaggattggaattagttgatgcaacatgtccatttgtcagaaagatccacaagatcgtagagaaagcgggcaacgatggtgatcaggtgatcatcgttggaagtgagcaccacccagaagttcagggaatcaaaggatggtgtactggagaagtgcatattatctcagatgcagagcagtttgaagggatcgatcttaacaagccgacgactcttgtatcacaaacgacatttaattacaagaaatttcaagatttagttgaaattctgaataaaaagggttatgatataggagtatgtaatacaatatgtaatgccacggaagagcgtcaactggaagcaaagtctatcgctaagggtgtagatgcaatggttgtgatcggagataagcaaagctccaacagccagaagttatatgagattagtaagaaagagtgtgagaacaccttttttgtgcagacacttagagacctggatttgaaactttttgaatcgactggtaaggtaggtattacagcgggggcctcaaccccacagaaaattatcaaggaggttcatgctagcatgacagaaaagagttttgaagaattattagaggaaagttttgtgacaattcacaacggagaggtagtgaaaggtacagttatcgatgtgaaaccagatgagatcatcttaaacatcggatacaaagcagatggtatcttaacaagaagtgaatactctaatgattcagccaacgtagatttaacaactgttgctaaagttggtgatactatggagactaaggtattaaaagtgaatgatggagaaggacaggttcttcttacttataagagattagcagctgaaaaaggaaacaaacgtttagaagaagctttcgagaataaagaagtcttaaaagcacctgtagctcaggttttagatggtggattaagcgtactgatcgaagaagcacgtgtattcatccctgcaagtttagtttctgattcttatgaaagagacttaaagaaatacgaaggacaggaaatcgaattcgttatcagcgagttcaaccctcgtaagagaagagtcatcggagaccgcaaacagttattagtagctgctaagaaagaaaaacagaaagaattattcgagaagatcgaagcaggaatgaaagtagaaggagttgttaagaatgtaacagacttcggtgcattcatcgatttaggtggagcagacggacttcttcacatttctgaaatgtcttggggacgtgttgaaaaccctaagaaggtcttcaatattggagataaagtaacagttctgatcaaggatattcagggagaaaagattgcattaagcttaaaattcccagaagagaatccatggttaaaagcagaagagaaatacaaagtaggaagtgttgtaacaggtaaagttgcacgtatgacagatttcggagcattcgttgagttagaatcaggaatcgatgcacttcttcacgtttctcagatcgcaaaagaacatatcgacaaaccatctgacgtattaagcgttggacaggaaatcgaagctaaagtagttgacttcaagaaagacgacaagaagatcagcttaagtatgaaagcattagctaacgaagaagaaaaaacagaagaataagatctttatcaaagaatcctgatttttataaatcagggttcttttttcgtacaagtattgtaaaaaaacaagttttgcgatataatcagttttaaaaatacatttttttaaaatgataaacctcgaaaaggagttatgaccatggaattaaagaagtttaaaaaagtattggttgcaaaccgtggtgagattgcgatccgagttttccgagctttaaatgaacttggaattacaacggttggtgtcttttcaaaagaagaccgttatgccttattccgttctaaagctgatgaatcttatcagttgaatccggacaaaggaccaatcgatgcctatcttgacatcaatacgatcattcgtattgcaaaagagaagaacgtagatgcaattcatccaggttatggatttttatcagagaatcctgactttgtagatgcctgtgagaagaatggaatcacatttatcggaccatcctcaagcttaatgcgtaagatgggagataagatttcttccaaacagatggcaattgaagctgatgttccaatcattcctggtgtagaccatgcggttcacggactggaagaagtgactaagattgcgaaccaagttggatatcctgtaatgttaaaggcttccaatggtggtggaggacgtggaatgcgtatcgttcattcagccgaagagatgccaaaagaatatgcagaagcaagagatgaatccaagaaagcatttggagacgatcagattttcgttgaaaaatacttaaagagtccaaaacatatcgaggttcagatcattggtgatcagtatggacatgttgttcatttatatgaccgtgactgctctgtacagagaagacatcagaaggttgtagaatatgcaccagcattcagcgtgccagaagaagtaagacagcagatttttgaagcatctatccgtcttgcaaaacatgtaggatataagaatgctggaacattagagttcctggtagatgcagataataatgcatactttatcgagatgaaccctcgtgtacaggtagaacatacgatcacagagatggtaacaggaatcgatatcgtacagacacaggttcttgtagcggaaggatattctttagattctgaagagatcggtattggatctcaggaggaagtgacatgtaatggatactctattcagacacgtatcacaacagaagatccaatgaataacttcctgccagacacaggtaagattacggtatatcgttctggagctggtaacggtattcgattagatggtggtaacgcatatgcaggagcagagattacaccatactatgacagcttattggtaaaagcgatctctcatgatcgtacatttggaagagcggttgacaaatctatccgtgtattaaaagagattcgtattcgtggagttaagacaaatatcccattcttgatcaatgtattaaataatgagacattccgtgagggaagatgctatacaacatttattgaagaaacgccagaattattcttacttccagaaagtcaggatagagcaacaaagatccttgaatttttaggaaataagatggtgaatgtgcagaaagccgttcttgacaaaccagattttgaagcaagaactcttccaaagtatgatacagagaagaagatttatggttccagagacaagttcttagagatgggagctaaagacttcacacagagcctgttaaatgagaagagattactgatcacagatacaacaatgcgtgatgcacagcagtctttaatggcaacacgtatgagaacaaaagatctgatcggagcatctgatgcgacaaacgcatttatggagaatgcattctctgtagaggcatggggtggggctacttatgatacagcttatcgtttcttaaaagagtctccatggaagagattaaaattattaagacaacatatgccaaatacattgatccagatgttacttcgagcatccaatgctgtaggatacagcaactatccagataatgttgttaagaaattcatcgaagaagcatcacaaaaaggtgtagatgtattccgtatcttcgacagcttaaactgggttgagaatatgaagatgccgatcgagacagcattaaagacaggtaagatcgtagaaggaacgatctgctacacaggagatatcacagatccaaacgagacaaaatatacattagattactatgtaaagaaagccaaagaattagaaagcttaggtgttcatatctttacgatcaaagatatggcaggtcttgtaaaaccatatgcagcgaagaaacttattagtgcattaaaagaagaattaaatattccagttaatcttcatacacatgattctactggaaatggtgtcagcacattattaatggcatctgaagcaggactagatatcgctgactgtgcgatcggttctatgagttctatgacaagtaacccatgtatgaattcattagtagaagcattaaaaggaacagagcgagatacaggacttaatccagatgaattaacagaattaagtcagtactatgcaagaatccgcccaatctacaaacagtttgagagcggaatggatgcgccaaatacagagatttacaaatatgagattccaggtggacagtactctaatctgttagcacaggtaaaagaaatgggtgcagcggaagactttgaagagatcaaaggtttatataaagatgcgaaccagctgcttggaaatatcgttaaagtaacaccatcatctaaagttgttggagactttgcgatctttatgttcaagaatggattaacaaaagagaatatcttagaagttggtaaagatttatcttatccagattctgttgtagaatattttgaaggtatgatcggacagccagaaggtggattcccagaagaattacagaagatcgtattaaaagataagaaaccgatcgatgtgcgtccaggaagtttattaccagatgaagattttgattatattgcaaagggattaaaagaaaacttctatacagagaatatggaagatccagatatcttaagccagaagacattaagctatgcgttatatccaaaagtatatgaagattactgtagacattttgaggcttacaatgatgtaacagaacttgaaagtcacgtatatttctatggattaagaaaaggtgaagagacaacactgaaattagatgaaggtaaatatctgatcatcaaatttatcgatatgacagagcctgatgaagatggataccgactgttagactttgaagtaaatggatctatccgtgagatcaaagttcttgataagaatttagaggttaagacagaccgaagagttaaagcagataaatctaatcctgcacatcttggatccacaattccaggaacagttggtaaagttcttgtcaatgaaggtgatgaggtcacagtgaatatgccgctgatgacagttgaagctatgaagatggagacaactgttgtttctacggttaatggtaaggttgataagatctatgtcaaagaaggagaacaggtaaatcaggaagatctgttaatctcttttgaaattgatgaatagaaattgaattagatttcatactaaagaaggaagtaagaagatgcttccttctttttttagtgcaaattgcagagcatcgttctaaataataaagataaaaaatatgatacaggaaggtaagattttggtatgaaagataatgagagacaagaaatagaaaaatttggacagttgcaggaaaatgggatttttacgatgactatcattggtgagatcgaagggcatcagttatctgcacaaaatgcaaagacaacaaaatatgaacatatgataccggctttagcaaaggttgagcaggatgaaagtataaaaggaatcttaattttgatcaatacgatcggtggagatgtagaatgtggacttgcgatcgcagagcttatcgcatctctaagcaaaccaaccgtatcgcttgttcttggaggaagtcattcgatcggagtaccgcttgctgtggcagcagatcattcttttattgtgaaaagcgcaacaatgatgattcatccagtgagaagttctggaacatttatcggagttattcaaagttatcgtaatattgaaaagattcaagatcggattacgacatttattagtgatcattgtaaaatgaaaaaggaaagagttgaagaattgatgcttcatattggacagcaggtaaaagatgttggtatgatcctttcaggggaggaggcagtaaaagaaggattgattgatgagatgggtggaataaaagaagcaacagacagattgattgaaataattaatcagtctgaaaataaatagaaaacttgaataaaaaacagataatacctttataatattcctgttttggtatatgataagaataacaaatatgttaaaaaaaacacaaactttcttaaggcatcattagaggagggaatatcatgagaggaatacagacaccagttcggaatgtgagaagaagaattttcaaagagatcgcaaagtttggttacgaacaaagaaacttacaggatcttgaagatcttccatatgagatcgtacctggagaagttgcaaaatatcgagatagcatttacagagaacgagcgatcgtaggtgagagactgaggcttgccatgggaatgtcattaaatccagcggataaaccaacaagaattacgaaagaaattgatgagagcaatatttcagagaaatattatgagccgccacttcttcaggtaattccatctgcatgcaatgaatgtaaggagaaggcatttattgtaggagagcagtgccagggatgcatggcacatccgtgtatggaagtttgtccgaagaaggcaattagttttaaggatggatattcttatatcgatcaggaaaaatgtatcaaatgtggacaatgtaaaaaggtttgtccatatggtgcgatttatgaaagaaaacgtccttgtgcaaatgcctgtggggttggagcgattgaaacagattatgcaggaagagctaagatcaatccagataaatgtgtttcttgtggtatgtgtatggtaaattgtccgtttggagcaattgcagataaatcccagatttaccagttgatcaaggcaatgaatgaaggtgcggaagtgatcgcaatcttagcacctgcatttgtcggacaatttggaccaaaagcaacgccaaataagattaaagctgcacttcttgatattgggtttgcagatgtgtgggaagttgcagttggagcagacgcaggggcactagaagaggcaaagcattatgttcaaagtgtagctacagggaaactaccattcttgctgacatcatgctgcccatcatggtctatgcttggaaagaaatattttccagaggtgatcgatgaaatttctaatgcactaacaccaatggtagcaacggcaagagcggcaaggattacatctccaaatgcaaaaattgtttttgtagggccatgtgttgccaaaaagttagaagcatccagacggacagtgcgaagtgaggtcgattttgtgatcacatttgaagaattggctggaatgtttgatgcgaaagaaattgattttaacacatatgaaaaagaagaagagttaaatgatgcctttggagccggacgtggatatgcagttgcaagtggagtagctggagcgatcaaggcatgtattgatgaatactatcctggaacagaagtaaagatcgatcatgtggaaggtcttgcagattgtaagaaaatgcttttacaggcgaaagcaggaaagaaaaaaggctatctgatcgaaggaatgggatgtccaggtggatgtgttgcaggagctggaaccaatataccagttatgaaagcacaaattcaggttaagaagtttgtaaaagaagcggaagattttgtacctccagaaactgcacaatattaagaggttaaaagaaaagggaaatgtatgggagataaatacatttccctttttctatggtgggacttgcgtattttgataattaattgtaaaataagaaaatacgcagattatgtatacaaaatgtatacaaagagaggtaacaatttctatggcagcaaagaagacaagaaagaggaagacatcttctgcaaagaaacggacacgcacaagacaaaaagattttgcaccgttttataaagagattgcagtattagttgtttttgctcttttcatttttttatttttaagtaattttggaatatgcggatacataggaaacagcatcagtacatttttctttggagcgtttggaacgactcattacatcattccggcggtaagctttattctggcaattttattgatctccaatgattacagcagtcttgcagtgaagaagacatgttttgcgatcctgctgttatgtatggtatccacaatttttcagatgatatataatatagaagtaagagatgcttattcagcctttgtatttagtggaagaacccacagaggaggcgggtatctgggtgcattgatctgttcaatcctttataaggaactgggaggggcaggaagtgttttggttgttttattgatttctgtaatctcattgatccttgtaacagagagatctttactttctttccttaagaaagcagttgatttctttacagtagaaggatatgaagaagatatagaagaacgactagcgaagaagaaacgaaaagcaaaagaggtgtccaaagaggataaagaaacagcaccgagaaagaaacgatcgatgcatattccggatttgcgatctggaagaccgaaaccatcacaggcatctccaatgccgcctatggaaccagaagagaaaacaaaacaaacaccgatacagaaggattttgatgatctgatcgttcaagaagaaacagacaaagaaccaaaagaaatatttgaaccagtacagccgaatgcatcgaagaaatctcttgtgaataaggataagaatacaccatcgaaaccagtggagattcttccgcaggttcggactaaagaaggagattataagtttccaccagtatctttattggagaaaggaaagaaaacagcgggaaataacaaagaagaacttcgtcagactgcacaaaaactgcaaaaaacattggaagatttcggagttcatgttacaattaccaatattagctgtggaccatccgttacacagtttgaattacatccagaacaaggtgtgaaagtcagcaagatcgtaaatcttgcggatgatattaagttaaatcttgcagcagcagatattcgaattgaagcaccgattccaggtaaatcagcaattggaattgaagttccgaataagacaaaccagatggtaatgttcagggaactgatcgagaatcaggaatttgcacaggcaagatcaaagattgcatttgcagtaggaaagaaccttgctggacaggtgatcgtgtcagatattgccaagatgccgcatcttttgatcgcaggagcaacaggttctggtaagtcagtttgtattaatacattgatcatgagtattttatacaaggcaacgccagatgaagtgaaactgatcatgatcgatcccaaggtcgtagaattaagtgcatatcagggaattccacacttgctgattccggtcgttacagatccgaagcaggcatccagtgcgttaaactgggctgtgatggagatgggagagcgatataagaagtttgcagaagtgaatgtaagaaacttaactggatataatgagaaggtcgaggaatcgatcaagaatggtatggaaggggaagattttaagaaacttccgcagatcgttatcattgtagatgagcttgcggaccttatgatggttgcaccgggtgaagtagaagatgcgatcgtgcgcctgtcacagcttgccagggcagcaggaattcatctggtgatcgcaacacagagaccatctgttaacgtcattacaggcctgatcaaagcgaatgtaccttcaagaattgcattttcagtatcatcaggagtcgattcaagaacaattatcgatatgaatggtgcagaaaagttattaggaaaaggtgatatgctgttctatccatctggatatcagaaaccaatccgtgtacaaggtgcatttgtcagtgatgaagaagtcagcaaggttgtagaattcttaaaggaagaaaataatgccgaagacagctatggtgcagacattcaggaaaagattcagacagctgcggtcaaagcagcaacatcgcaggaaagggatgaatattttgaaaaagcagctgagtttattattgacaaagacaaggcttcgatcgcaagtcttcaaagagtctttaagattggatttaaccgtgcagcaagactaatggatcagttatgcgaagcgggaatcgtcggagaagaagaaggaaccaagccaaggaaagttcttatgagtgaagaacaatttgaacaatacaaagaagattatctatagaaaggaaactattatgaaaacagatattgaaattgcacaggaagccacattattaccgatcaaagaagttgcagcgaatatcggaatcaaagaagacgaccttgaattatatggaaaatacaaggccaaatttgattctcatttcatggatgaagttaagaataacgaagatgggaaacttgttcttgtgacagcgatcaacccaactccagcaggtgaaggaaagacaacaacaagtgtcggagtatcccaggcgttaaacaaacttggaaagaaaacaatctgtgctcttcgtgagccatctcttggaccatgttttggtatcaaaggtggagcagccggtggtggatatgcacaggttgtaccaatggaagatttaaaccttcattttacaggggattttcatgcgatcacatctgcaaacaacttattagcagcaatgcttgataatcacattcagcagggaaacaaattaaatatcgatacaagagatgttgtatggaagagatgtattgatatgaatgaccgtgcattaagaaatacagtcatcggacttggacgtcgtgtggatggtgttgtccgtgaggatcattttgtcatcacagtagcatctgagatcatggcaattctttgccttgcaaatgatatggcagatttaaaagaacgtttaggaaagatcatcgttgcatacaacatggaccgtgaaccagtcacagccaaagacttgaatgcagttggagctatggcggcattattaaaagatgctattaaaccaaatatgatccagacattagagcatacaccagcattcgtacatggtggaccatttgccaatatcgcacatggatgtaatagcgtacaggctacaaaattagcgttaaaattagcagatatcgcaattacagaagcaggattcggtgctgaccttggtgcagagaaatttatggatattaagtgtcagatggctgatcttcatccagatgcagttgtattagtagcaactgtacgtgctttaaaatacaatggtggagttccaaaagacaatctggcagaagaaaatatcgatgcgttaagcaaaggtatcgtaaatcttgaaaaacatatcgagaacttaaaattgtttggagttcctgttgttgtaacattaaaccagtttgcaacagatacagaggcagaacttacatttatcaagaatttctgcgaagaaagagattgtgattttgcattatctcaggtatgggaaaaaggtggagaaggtggaatcgaacttgccaaagcaatccttcgtacattagataataaagaaagcaattacaaaccattatatacatatgatgatacaacgatagaagaaaagatcgaaacgaccgcaactaagatttatggagcagataaagttgtatacacagcagctgcagcacgtcagaagaagagactgactgaacttgggtatggaaatcttccaatctgtatggcgaagaaccagtattctttatctgatgatcctaagaagcttggacgcccagaaggatttgatattacgatccgtgagatctatgtcaatgcaggtgcaggattcttagtagccttgacaggtgatgtcatgacaatgcctggacttccaaagaaaccagcagcagaaggaatcgatgtaaatgacgatggagttatcacaggattattctaatcaacaaaaataaagccaatatatacttaaaagaaatgacgaggaaatacaatgcagattattgatggaaagaagatttctcaggaaatcaaagatgaagtaaaagaagaagtagcgcagctgaaagcagagggaaaagatattgcgcttgctgttattcaggtaggagcagatcctgcatcaagtgtttacgtacgcaataaaaaacgtgcctgcgagtatgtaggaatcgagtctgtaagctatgagcttccagaagagacaacacaggaagaattaatggcgatcgttgataaatgcaataaggatcctaagatcaacggaatcctagtacagcttccacttccaaaacatttggatgaagatgaagtattattagcgatcgatcctaagaaagatgttgacggattccatccagtcagtgttggaaatatggtgatcggagaaaaaggattcttaccatgcacaccagccggagtgatccagttattaaaacgttctggtgtcgaaattgatgggaaagaatgtgtggtagtcggaagaagtaacattgtaggaaaacctatggcaatgttattattacgtgagaacggaacagtgactgtctgccattctcatacaaaagacttaaaagaagtctgcaaacgtgcagatatcttggttgtagcaattggtaaaccaaaatttattgatgattcttatgtaaaagatggagcagttgtcattgatgttggaatccacagaaatgaaaataacaaactttgtggtgacgtagattatgacaaagttgcaccaaagacatctgcgatcacaccagttccaggtggagttggaccaatgacgatcgcaatgttaatgaaaaactgtgtagaatctaagaaattgtttggagagtaagagaaatgaagatattatttatttcgcttggatgtgataaaaacttagtagacagtgaagttatgcttggccttttgaccaagcatggctacactttgaccgatgatgagacacaggcagatgttattgtaattaatacatgctgtttcatccatgatgccaaagaagaaagtatcaatacgatcttagagatggcacagtacaaagaacagaatctgaaggcattggttgttgctggatgcctcgcagaacgttataaagacgagatcttaaaagagattccagagattgatgcggttcttggaacaacaagttatgattctattgtagaagcagtgaataccgcattagaagaaaatacaggggaacattttaaacattacgaaagtattgattatcttccagataattctgaagtagaacgtgttgtaacaacaggaaatcacatggcatatttaaaaattgctgaaggttgtgacaagcgatgcagctattgtatcattccaaagatccgcggacgtttcagaagtgttccaatgcaagaactgttgaatgaggcaaagcgtttagcatctgaaggagtgaaagaattagtactggtagctcaggaaacaacactgtatggcaaagacctgacaggagaaaaacagcttccgttattacttcatgaactttgcaagatcgaagggattgaatggatccgtctgttatactgctatccagaagagatcacagatgagctgatcaaagtgatcaagacagaagagaaagtctgcaattacattgacatgccgattcagcatagtgagaatcgtatcttacagagaatgggaagaagaacatcaagagaagatcttgtagcagtgatcaagaaacttcgtaaagagattcctgatatcacgatccgtacaacactgatcactggatttccaggagaaagtcaagaagatcatgaaggattaatgaactttgtagaagaatgtcaatttgatcgtttaggagtctttacttattcaccggaagaagatacactggcagcaacatttgaggatcagatcgatgaagaagtcaaagaagaacgaagagatgaactgatgagtcttcagcaggagatttcctatgaacatacccagcagttagtcggtaaaacgatcaaagtcatggtagaaggatatttatttgaagatgatatctacgttggacgttcttatatggatgcaccaaaggtagatggatgtgtttttataaattctccagaagaattgatgacaggagactttgtttatgttaaaattacccagggtagagaatatgatgtgataggagaagtagattatgaatttaccaaataagttaacaattttaagaacacttatgatcccggtattcttatttttcttgctgacagattgtgcaggggattatagcaagtggatcgcagttgttgtatttattctagcgagtcttacagactttttagatggacatattgcaagaaaatacaatctggtaacaaacttcggaaaatttatggatccattggcagacaaattattagtttgttctgcaatgatcgcattagttggaatgcaccgtttatcatctatcgtagcgatcattattattgcaagagaatttatcattagtggattccgcctgatcgcctctgataatggaatcgttatcgcagccagctactggggaaaatttaagacaaactttcagatgtttatgatcattatgctgatcattgatcttggaacaagcacagctgtgatgatcgagaatattttgatcgtcattgcaacagccctgacaattatttctttagttgattatttggtgaagaataaacaggtattatctgaaggaaattagatccagaaaggaacaacaattatgacagcagaaattatttgcgtaggaacagagattttattaggaaacatcgtgaataccaatgctgcctacttatcagaacgcttagcctcattggggataagcgttttttttgagacgacagtaggcgacaatccagaaagattagaaaatgtgatcagacagggacttgaaagatctgatattttgatcttatctggtggacttggaccaacgaaagacgatcttacaaaggaaattgcaacgaaagcatgtggacaggggcttgtagaagatgaagaagcactaagacgcttgaaagaatattttgcgagaagtcatcgtaacatgacagagaataatttaaaacaggcattagtgccagaagattgtactgttttatataacgaaaatggaacagcaccgggaatggtcattcatgcaaaagaagggaagaaagtagttttactcccagggcctccaaatgaactgcttccaatgttccatgatcaggtagaaccgatcataaaagaattaagttcagaggtattatactccgatgttgtgaagattgattgtatgggagaaagccgcgttgcagcagagattgaagatttgatcgaaaagcagacgaatcctacagttgccccatatgccaaattaggagaagttcatcttcgagtgacagcaaaagcggtaagtgaagatgaagcaaagaagcttgttacaccaataacagaagaattatacagaagatttggtcataagatatttacgacaaaagaagatgaaacattagaagatgttgtggttgatatgttaagtaaacatcattatacgatcgcagcagcagaatcctgtacagcaggaatgtttacagcaaggttagttaatgttgcaggagcatcggatgtcttaaatgaaagtttcattacatatgcaaatgaagctaagatgaaatatcttggagtaaaagaagaaactctaaataccgttggagcagtttcagaagatacggccagacagatggcggaaggtgttgcacgacaggctggttcaaatgtcggtgttggaatcacaggtcttgctggaccgggcggtgaaacacctgagaagaaggcaggacttgtttacatcggtgtcagtgttaatggaaagacgaaagtaaacaaataccagttaaacggtaacagacagaaagtcagagaaacagctgtatgcagagcgttaactatggtaagacatgcattggttgaagagtttctatgagaatcatcataagaaaaaggatcacgaataaaaatcgaacaaatattcgctcgaacacttgttttttagtgtaaggatatgctatactctaaacaggaaattaaaagatagaagaatataagataaatatttgaaattaaaaggagtaaacatatatgaaacaggaagagaaattaaaggcattggatgccgcattggttaagatcgagaaagactatggtaagggatctgtcatgaaacttggagagtaccaggcagaccgtacgatcgaagtaacaccaacaggttctatcagtcttgatatcgcattaggagtaggtggagtacctaagggacgtatcatcgagatttatggacctgaatctagtggtaagacaacagtagcacttcatatggtagctgaagtccagaagagaggcgggattgcaggattcattgatgcagagcatgcccttgatccggtctatgcaaagaatatcggggttgacattgataacctttatatctctcagccagatacaggagagcagggacttgaaatcacagagacaatggtaagatctggagcgatcgacatcattatcgtcgattctgtagctgcattagtaccgaaggcagagattgatggagatatgggagattcgcacgtaggtcttcaggcaagattgatgtcacaggcacttcgtaagttaacaggtgttgtaagtaagtttaactgcacagttatctttatcaatcagttgcgtgagaaagttggagtcatgtttggaaacccagagacaacaactggtggacgtgcacttaagttctattcatctatccgtttagatgtcagaagaacagagacattaaaacaggcaggagagatgatcggtaacagaacaaggattaaagtagtgaagaataaggtagctcctccgtttaaacaagcagaatttgatattatgtttggaaaaggaatttccaagtatggagatattttagatcttgcagcagatgcagatatcattcataagagtggtgcatggtatgcatacaacggagagaagattggacagggtagagagaacagcaagaagtacttagaagatcacccggatatcgcagagacagtggaacatgcaatccgtgtccaatatggactgttagaggaagatgctgagaatgccaacaacgatcctaaggcagaggctcaggtttctgaagaataatgatcattacgaaactagataaagtaggaacaaagcaggtcaggcttttcttcgatgaagaaaagtactgcctgctttactataatgagataagacgattgggattccatgaacaagacgagatcggacaggaagaatttgaagaattaaacaaattactgttgcatcgggcgaagttaaaagctatgtcattgttaaaatatcaggatcgtacaaaaaaggaattaaaagaacgtcttatgagagcagaatttccagaatttattacggaaggggcagttgcgtatgtggagtcatttggatatatcaatgatgaagaatatgtacgccgctacatggaatacaagtcaggaagtaagagtaagattcagattaagatggaccttcggaagaaaggaatcactgcggagacattagagagggtctttgaggaatatgaatacgaagaagatgatatcttggaagaacaggttaagaagaggatccggcaaaagggttccgtcactaaggagaattttcagaaatattacggatattttgcgagaaaaggatttaatagcggcaaaatattagatttattacggaaatacatggaagattaaataaattacaggctaaatattaaaaaaatataaagaattcatcatttggttgcatattgacagataaaattatataatttgagtcaaagggtgtaacaaagcagatgacgacgatatctggaaggaatatatgatccggatatggttccaattataaggagtatcatttatatgagaaagaaatcacatatttcattagcagggcagattatggattctatggaacttgacaatgtattcgattatagattaccgttttatgtaggaagtatctggccagactgcagaccatcatttgtgacgacacctcataagtttgatattacatttgatgatattgaacgtaagatttcaaaatttattgccaattacgataaagataagggaatgaatatgcgacgttgtgcaggtcttggtgtgatcattcattacattgcagattattttacattcccacataatgatcattatccaggcaatgtaaaggatcattgctattatgaacgtgatctgaagtttggaatgagagcatttcttgagacagaagaagcagcacagatcaaggagcatgttgcggcatatgattctgtggaagaattgacatcatatattagaagtattcataattcttatatgaagcttgcacatacagtagaagaagatatcagatatatcgtacatgcatgtacaaccgttgtgaagagtgtactgaatatggtaagttatgcagttagtacaagtgtgatgaatattcagtatgtataggacaaggaattgaagataaaataataaagaaaaagggcaaagacagacagagatgatttgtttttgctctttttattgaaatcagtttgtaaaaaatgataaaaatatgatgcaagtatgatgcaaagaattcgtaaaataaaaaaggttttgggcagcatacaaaaacaataaggaaaatcaataaaacaataaggagaacaattatggtgaacatcatggtcgtggaagatgaaaagccaatttcaaatctgattgcactaagtttaaagaaagccggctatcatagtgaatgtgcttatgatgggttagaagcaattgatatgctggaaaagaattatccagatttgatcttactagatatcatgctgcccggggctgatgggtttgaaattttagaatacgtaaaaccattagagataccagtcattttcctgacagcaaaaggagatcttaatgacagagtaaatggtctgcgatatggagcagaagactatattgtaaaaccatttgagattatggaattattggcaaggattgaggttgtattaagacgatatcacaaattagatcgtattatcaatatattaggtttagaaatcgacacagatgcaatgtgcgtaaaaaaagaagggaaagaaattaacttgaccaagaaggaatatgatacattattgctgtttgcaaggaatcctggaaatgtattattcagggaaataatttatgaacgtgtttggggtggagattacattgcgggaagcaggacggtagatcttcatgtgcagagagttcgaaagaaagttggctgggaagattttttgatcactgtgcccaagatgggataccgtctggaggtaccaagatgaaatttcgttggaaattaatgatcataacaatgttgatcgtttcattttcatttggatttggaggaatgttgctgattcaatattcatatcaagcatctatcaaacaagaaaaaagagcagcaaggaattcttacgaaatgatcttaagaatgttaaaagaaattaatgagatggatgatacgtatcagaatcaaacatttgcgagtgtattgaagcgattaaactggcagggcttgttaagagacagctcagttcgattattaaaggaacaacatggagaggttcaatggaagcagccactttattacaatcgtaaaaatgataattttaggagaagcaatggtttttcaacgaaacagggaaaagcggtagtattccaaaataaaaataaagtatattatcagattactagtaagatttcttatggaaaggaaactatggtttttcagggagcatatgatatttcagaagtatatgcgacaaggcatcagcagttggtaagttttcgtaagatttttgtattagtaataggaattgagattgtagtatcctattttctggcaatgatccttacaagaccattacagaaattgtcgcaggtttcgaagcagattgcagacggtgattattctgtcagggttccagtgcatacagaagatgaaattggagaactttcagttagttttaattatatgacagaacaattgatagaaaagttaatgaaattggatcaattgttaaaaaatcaggaagaatttatgggaagttttgctcatgaaatgaagacaccacttacatcgatcataggatatgcagatctgatgcggatggaagctctttcgaaagaagagcaaaaagaagcatgtgggtatatttattcagaaggaaaacgattacagaatttatcattaaaattaatgaaacttcttgttttgaaaaatcaacagtttcagatgaaaaaacaagatttagagccaatgattcaagaagcagttacatccatgcagtatcgtttaaaagaacaagatattcttgtgaatttaaatttaaaaaaagcaatttgtaagatagagccggatttattgaaatcattaatattaaatttgatcgataatgcattaaaatcaatgaattcgggtggaatattaacagttgaggatcgagcaacacaagaaggagccaagatttatatttcggatactggatgcggaatgccaaaggatgagataagtaagatcacggaagcgttttaccggatagataagtcaaggtcaagaaaacaaggtggagtaggtttagggcttgctatatgtaaagaaatcgtgaggatccatcaaggagagatgcgatttatcagtcagcaagggaaaggaacaactgtgatcataacaattggaggaggagcttatgaaaaaacaaattaggaatgctcttcttgttgtggcggctttattacttgtggtcttgttttactttttaccaaatattcaggcagctctggtggacaaaaaaacgtttgggcagagtgaggatctatccttaaatccagtagagatttcggtagaggctactcagacaactctggaaaaattaaagatcatcaataatcatattttgagtgtagcagtaagaccttcatcaagaactgtggatggaagagatgtagaaaaaactgcaaaaaaacagacgaatctattattaaaaaaaatgaaaatcgcttatcgggtagaggaagactggaagattacatataaaaaattatacacttatatcaagaaaaaggatgatatgatcgatgaaggttccgtatctaatatttcgaatgtcaaaaatcttctggtatggtatattacattatcaccagaatcgtcggaggatgaaatagtgaatcttattatggatgcgtatacggatcagattttagcgattgatgtgtactcttatgattacacaaaagattggaaagatatcgcagatcatttggaagatattccggctggatttttgtcttatctgaatctgaaacagtcagagtataatttgaagaagcgtttgatgggcaatgtcaatgtaacagaacaataccaaaaagcaaaatcagcaaagggatcttattctcagatttcgggcagaataggtatttatgcgatacaaaataaaaaacagacatacattccaatcgaatggagtggttatggatttatgatcaacaatgtatacaacaactgatgcaaaataaagatttgctcttgtattttgaaagctttctctctataataaataaacggaaccctacaaatatagtaggatacgaaagaaaggttgaaagcatgagcaatattaatatttcatataaagaattaaaacagttagaaaaagggagttatcagcttcttgatatgagagatgaatcaaacacatcttatggaatgatccctggagctgttgtggcagcaggtgaagatgagcttggaacacaggcaaaggaatatattgatcagggtaagaaagttattttatattgtaccaagggaattttcagcaaggaggcagcagaaaaattagcggaagaaggaatcaatgtccttagtttggaaggcggatacacaggatggttgttatccttgatgaaagaagaacaggaaaacgatcagaaaacagaacaaaataacaaagaagccgaaggaaaaggcaagaaaaaagaactgacaagaacacaggagattgaaaagagcatccgtaagaagtttcacaaacagatattctccaagtttgtaaaagcaatcaagacatatgatctagtgcaggagaatgataagatcgccatctgtatctctgggggaaaagattccatgttgatggcgaaattatttcaggaattaaaacgccataacaaattccattttgatcttgtatttttagtcatggatccaggatataatgaaatgaatcgacaaatcatagagaataatgccaaattattagatattccgatcacagtctttgaatctgatatttttgatgctgtttatgagattgagaaatcgccatgttatctgtgtgcaagaatgcgtcgtggatatttatacagcaaggctaaagagcttggatgcaataagattgcgttgggacatcactatgatgatgtcattgagacgatccttatgggaatgctttatggagcacaggtacagacgatgatgccaaaacttcacagtacaaactttgaaggaatggaactaatccgtccgatgtatctgatccgagaggatgatataaagcattggagagattacaatggattacattttatccagtgtgcatgtaagtttacagatacttgtacaacatgtaatccagacggtgttacgaaatccaagagaatggagacaaaacagttgatcgcgaagatgaaagagatcaatccgtatgtagagtccaatattttcaagagtgtagaaaatgtcaatttaaagacgatcattgcatataagaaagatggagtaaaacattcgttcttagatacttacgatcaggaaaattaaataagaataaaaacacagagattggtgataaaatctctgtgtttttgtttagaactatgaaattattcgtcgtcttcttcaatctcaacaatctgacgttttctggcagcttcgtcattttccagatattcgtcgtaagtacattctttatcaatcagaccattcggagtgatttccatgatacgattagctgttgtctgtacaaactgatgatcctgagaagtaaacaataatgcaccagtgaaatcttttaatgcttcatttaaagcagtgatagattccatatctaagtggttggtaggctcatcaagaagtaagatgttggctccgctgatcattaatttagatagcatacaacgaactttctctcctccagataaaacaccaactttctttaatgcgtcttctccagagaataacatacgtccaaggaatccacggacaaatgttgcatctttatcttcagaatactgagtcagccattcaacgatcgtttcatcctgactgaaatcttttgtattatcttttgggaaataagactgcgttgtagtcactccccatttgtaagaaccagaatcaggttccatttctccggataagatcttaaataatgttgtagcagccaatgtattaggacctacgaaagcaatcttatccgttggtttcattaagaaagaaatattatctaagacttttacgccatcgatcgtctttgtaagattttcaacaactaaagcatcatttccgatttcgcggtttggcttgaagttgatatatgggtatttacggctggatggttttaactcatctagctggatcttatctaaagctttctttcttgaagtagcctgtttggatttggaagcattggcactgaatcttgcgataaagtcctgtaattccttcatcttttcttcttttttcttattggcttccttcatctgttttgtaagaagctggctggattcataccagaaatcatagtttccagagaataactgaattttcgcataatcgatatctgcgatatgagtacataccttatttaagaaataacggtcatgggatacaacgatgaccgtgttgtcaaagttgatcaggaattcttctaaccagtaaatagcgtctaagtctaagtggttggtaggctcgtcaagcagcaggatatctggatttccgaataaagcctgtgcaagtaagactttgactttctgagaaccgtttaagtcagccatctttgtataatggatatcgctaggaattccaagaccatttaataaggtagcagcatcagattctgcttcccatccattcatatcagcaaattcgccttctaattcactagcacggatgccgtcttcgtctgtgaagtcttccttcgcatataaagcttctttttctttcatgatctcgtataatctttgattacccatcataaccgtatcaaggacgatatgatcatcatactggtagtgatcctgtttcaaaacagaaagacgctgtccagaagtaatggatacatctccttttgaaggttcgatctctccggaaagaatttttaagaaagtggatttacctgctccattggcaccgatcagtccatagcagttaccttctgtgaatttaatatttacatcttcgaataaagcacgttttcctaaacgtaaagttacattatttgcctgaatcattgtataacctttctttttgatttataattaaatagaatgctcttttcattttacagaaaagctagagtttttcaagtaaaatttgcattgtgcaagtaaaaatacttgacaaaggcagtgaaattcgctaaactaacatctggtaaaggaaaattgctttacaggagtatcagatggaacgaatcgtagaacagaatttattatatgatttttacggcgaattgctgacagcacatcagaaggagatatatggtgaacatattttgaatgatatgacagccacagagatcgcagctgagtttggaattaccagacaggcggtgcatgatatgatccgaagatgtgataagatcttggcagattatgaagcaagacttcatctggtagcgaagtttttgacggccaaggagaagatcaaagagatccataccttatccagaaggcttcttaaagaagataaagagcagatggaagaagatatcagacaaatagaatctgtatgtaatcaggttttagaagatttataacttagatgaggtgaatcaatggcatttgaaagtttatccgagaaacttcagggtgtatttaagaacttaagaagtaagggccgtttaacagaagatgatgtaaaagcggcaatgagagaagttaaaagagctttacttgaagctgatgttaacttcaaagttgtaaagacatttatcaaatctgtacaggaaagagctgtaggacaagatgttctgaatggtttgaatccgggacagatggtgatcaagatcgtaaaagaagagatggaagcattaatgggatcaacgatgacagagattcagcttcgtccaggtaatgaaattacgattattttgatggcaggtcttcaaggtgctggtaagacaacaacatgtgcaaaacttgccggacagtataagaagaaaggaaaacgaccattattggtagcctgtgatgtatatcgcccagcggcgatcaaacagcttcaggtcaatggagagaaggtcggagtaccagtatttacaatgggagataagcagaatccagtggatattgcaaaggcttccgtagaacacgcacagaagaatggaaacaatatcgtgatcctagatacagcaggacgtcttcatattgatgagaatatgatgacagagctggttgagatcaaagagaatgtggatgtattccagagtattctcgtcgttgatgccatgacaggacaggatgctgtcaatgtggcaaaagaatttaatgagaaagtcggcgtcgatggaattatcatcacgaagatggatggtgacacccgaggtggtgcagcactttctattcgttctgtaacaggaaagccgattttatatgtaggtatgggagaaaaactggaagatcttcagcagttctatccagaccgaatgacaagccgaatccttggtatgggagatgtattgtcactgatcgagaaagcagagcagacgatcaatgaggaagacgcacttcgtatgactgagaagatgaagaaggctgagtttgattttaacgattttcttgatcagatggatcagatgaagaagatgggtggattatccaatctgttatctatgatccctggtgtcggaaacaagatgcagggacttgatattgatgatggtatgatggataagacagcggcgatcatttattccatgactaaagaagaacgtgctaatcctaagatcatcaatgcttcaagaaagagaagaatcgcagcaggagcaggagttccaatcgcggaagttaaccgcttatgcaaacaggttcagaatcagaaacagatgatgaagcagatgtcaggtatgtttggtggcaaaggtggtaaaagaggtggatttaaattacctttttaggccttagttatagaaaataataattaatttaaattacaaagaaagatttttggaggtaaaaacaaaatggcagtaaaaatgagattaaaaagaatgggacagaagaaagcacctttttatagagtagtagtagcagatgctagatcccctagagatggtagatttattgaagaaatcggaacatatgatccaaatcaggatcctagcgtgatcaaatttgacgaagaagctgctaagaaatggttagcaacaggtgctcagcctacagatacagtagctaaattattaaaagctgcaggaatcgaaaaatagtcagatttaagacaggaggcagtgcatgaaacatttattagaagtgattgcaaaagccctcgttgatcagccagataaagtgacagttacagagaaagaaactgccgatgcagtcgtattagaacttcatgttgccgaaggtgatatggggaaagtaattggaaaacagggaaggattgcaaaggcgatcagaactgttgtcaaggcttcggttgacaaaggtgacaagaagattgtcgttgatattcaatagaagattaaaagctcacaggaaagtgtacagaagatgtataaaactgtgggctttttgttatgtataaattcgagaaagtaagaaagcccttgaaaccatttcatttcaagggcaatttttataaatattaatcttctggcagatcaagtttatcagatttctcaaataaggattgaatttcaacaagagattcttccagagaatcctcaatggactctaatttatctgcatcaacgttataatttaaaaacagctgttcgatattttctgtaatatgatgaccaagatgggaaattaaaaggaaagtattaaaattgtgactattctttgcattttcaaaacgctttaagtctgctgtaataaaatcgataatttcctgatcactggcgaatttaccatggaccattgcatatggctgcatacgttgtaaaaagtatttattatgtcgtgtaatattaaaaacataagaaacaattaatccatcaccaagatcgaattcagcaatgtgcatgatgctgttaaactccttgatagaagtagcgcctaactgacgcagattgatattaatataatctccggttacggtattttgattcataagatcacgctcctctcctaaatattataatccataattttttattaagcaaatcgaatcaaaagaaatacggaacatacgatgatcgataagatcatcattgggaatccgatcttaaaatattgaccgaatgtaattggatgtccgttatttttactgataccagacaaaacaacgtttgcagaagcaccgatcagtgttccatttccacctaaacaagcaccgagtgacaatgcccaccagattggagtgacatccattccctcggcctgcatcgtaaggatcatagggattaatgttgcaacaaatgggatgttgtcgaggaaagaagatacaatagcggaaacccataagattaccatcattgtaaccaccatattaccatgagtgatagaaatcaatccatttgcaagcattgtgatgacacctacttttttcataccaccgacaacaataaataatccaataaagaaaagaatggtaggccattcaacgtctgcaatgatttcttcaggttcctgaccgccgatcaaaagcatgatacatgctgcagcaatagcaacagtacaagactgtacgcctaactggtcatggaaaataaagcataatgcgactaggatgataacgataacactttcatgcatcagttttcggtccttgatcgctttgttttcatctaactgcataacctttgcaattgattcgtctgtaacaaataactttcttccgtatataaaatacatacagatcagaccaacaatgataacaaatacagtggccacccctgtatttaaaataaaatctacgaaacttaatttggccgcactaccgatcataatgttaggtgggtcaccgatcagtgtagcggtaccaccgatattggaagccatgatctgtgtgatgatatatggtacgggatcaactttcaagatatttgtgattgccagagtcattggtcctactagcaagactgtggtaacgttatcaagcattccagaacatacggcggtgatcaaaataaagatcaccatgattggccatggacgaccttttgcgatttttgcagctttgatcgctatgtattcgaaaataccagaattcttgataacagcaaccaaaagcatcattccgactagaatacagattgtttcaacatcgactgcgtcaatacaatcttcaatcgaaagaatgtgggtgaggaccagacaggcagcaccggttaatgaggcaaccgtgttgtggaccttccctgtgatgatagcgcccatcgtacataaaaagatgatgatcgctatgatttgttgtaatgacataacaatttcctcctaaaaataaactcattattataatagacctcttttcaaatattgcaagtataaaatgaaaaaagaagtcgtagaaaacgacttctcagactgtagacaaagtcccggtatttgccgggacttttactatgagcactgtttttctggtataataaaattatcagaaaggcggtgttttttatgatgacgaaaaatgcagacaagaaacgagaacagatgatgatgttctcaatggattccatggttccgcaggatcatatgctaagattgattgataaagcaatcaactggaactttatttacgatcttgtagaagataaatattgtcaaaacaatggtcgtccaagtatggatcctgttatgctcattaaaattccatttattcaatatctttatggaatcaaaagtatgcgtcagacgatccgagagattgaagtaaatgttgcctaccgttggtttcttggtctggatatgctggatcctgtaccgcatttttcaacgtttggaaagaattattcccgccgatttaaagacacggatctttttgaacagatattttcaaagattctggaagaatgtatgaagtataagttgatcaatacggacgagatctttgttgatgcaactcatgtaaaagcatgtgccaacagtaaaaaaatgcgaaaaagagttgctcatgaacaggcactctggtatgaagatgaattacaaaaagagatcaatgaagaccgacaggcacatgggaaaaaacctctaaaagataaaaataagaagaatccgccaacacctcccacatctaggaatgatcaacataatgagcttgaacagataccagacgatataaaaaccaaaaagagcagtattacagatccagaaagcggatggtttcgcaaaggagaacataaacatgtttttgcatatgcagtagaaacggcatgtgatgaacacggatgggtccttggatatagtgttcatcctggaaatgaacatgacagccgaacatttcaaacaatctatgaaaaggtgaaaagttttgaaccagaaatgatcgtggcagatgcaggatacaagacaccagcgattgccagacaacttctgaaagataggattgaaccattgtttccatataaacgacctatgacaaaaaagggattttttaagaaatatgaatatgtttatgatgaatactatgattgttacatctgtccagaaaatcagattctaagatacagtacaacaaacagggatggatacagagaatataaaagctgtggatatcaatgtgaaaaatgtccacagatatccaaatgtacagaaagcaagaatcatgtaaaagtgataacacgtcatgtttgggaaaaatatatagaaaaagcagaagatatccgacatgtaagagggaataaagcaatctatcagaaacgaaaagaaacgatagaaagaatctttggaacagcaaaagaacaccatggatttcgatatacacaatacataggaaaagcacggatggaaatgaaagccgggcttacttttgcatgtatgaatctaaaaaaactggcaagatttcttggtaagaacggattgctaaatggacaaaagcgaagatttctaagaaatttttggatacaatttaactttaaagggaaaaatggtgctgggatgatcccagcacctagtttgtctacagtctgagaagtcgtagaaaacgacttcttttttagaaaaatttcacatcttatataaatatgatataggtgtgattataaatttgtaacaatctgatcgtatagatcaagctgacagtgctgctcagacacagaaaagtgtttacagtttaaacagctaggtgcttttgtgtcatctccggtactgacgttctttacggaatggtcacagccacaaggacagtactgactgcattcttcagcaacttcctgatacactttattctggttttccataatataaaagcctccttataataagtactcacagaatcacttggaaagaattctgtgagtacgacaattgatacctttatattatgtacagatttactcaggataattcagatttttatcatctgcaacgtataaagcgtttttaagatagtgatctgcaagataatttgccatcggaagattcatatcaagatagttaccacaatccttagcactggctccaggaacatcacctttaaaatcacgaataaattcaaaagtacttataataagaggtaatatatcctttgaagtaagatcgccagctaaaataagatagaatccagtacgacagcccattgggccaaaatagatgatcttatcctgccattctttgttatttcttaaataagtagcggcaagatgctcgatcgcatgcatctctgcggtattcataacaggctcacgatttggggctgtcatacgaagatcaaatgttgttaaagtctcagaaccaacggcatctttacgagaaacataaacaccgggtaacagttttaaatgattaattgtaaaacttgctattttttccatgatggatttcctttcttatataaaatgtgttatcactatagggatgattctaaaatcgttcactattatgcgatttagaatcatctaaaattttcatatcatattatagcgtgaaaatacaagaaaatctatggaataaaattagttttaataaaaatgaaaaaaagacaaaaagctgttgacatactgtatacatctgtggtaagatagtcaacgtcgctgaaagagcggcaggaaaatataacatcggagctgatctggcttctgaaaagaataaaaaaacttcttgacacaagtgatcagatgtgataatctataaaagttgctgacggagaacgatcagaacaatagagatcagatctgaaagaaaagttagaaagttcttgacagataagatcagaaatgatattatataaaagttgttgcagagcagaagagctcagaacaacaaaataaattaaaagagttcttgacaaacaaaaagaactgtgataaaataacaaagcttcttgcacacaagaagcggatcacaaaaagatctttgacaactgaacaataagacaaccttgaaaattctaatgaatttttcagatgattttagtaaaaatcaacgaacgttctttatagaaaacagtaatcaacaaggataaagaagctagtgcttcttgaacttggatcaacattgaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaagaagaagtaaaggttgttttattgttgagctgtcaaaggcttaaaactgaatattccggtggcgatgcgcgtcggggtcacacccgttcccatcccgaacacgatggttaagactgacgcggccgacaatacttggctggagacggcccgggaagataggtggctgccggatctataaaagagttttgctcttatcgatgattcgatctaagaataaacattcttggatggcatggtcgataagaccagaagtgtcgaagatacaggatattgtttctgaaacacggatgtaccttgaaaacttcatacaagaattaagatagaattcattttcagaaatggaaatgagtcaagacatcaaagaaattcaaatttcatcgttaataacgagataggaaaatgaaaaaaacacaaagcccgctgatgtaacgctatacatcagtgaggaaacagagaatcaagagattcgatcgttcctgctacggttaaagtagtaagggcgcagggtggatgccttggcactaagagccgatgaaagacgtgataagctgcgaaaagcttcggggaggagcacatatccaatgatccggagatatctgaatggggaaacccggcagaggaaacctctgtcagcgtgcagtgaatacatagctgtacgtggggaacctggggaactgaaacatctaagtacccggaggaagagaaagaaaatttatcgatttccaaagtagcggcgagcgaaatggaaagagcccaaaccgtgatgcgtgcatcgcggggttcggactgcgttgtggcagacgtaagataggagaacggactgggaagtccggccggagagagtgaaagcctcgtatccgaaatcccaagtcgcttagcaggatccagagtaggacgagacacgagaaaccttgtctgaacgagcggggaccaccccgtaaggctaaatacttcttagtgaccgatagcgcatagtactgtgaaggaaaggtgaaaagtaccccgggaggggagtgaaagagaacctgaaaccctgtgtctacaagctgtgggacctctttatatgagggactgcgtactttttgtagaacggtccggcgagttgtgcgtactggcgaggttaaggacttaaggtccggagccgaagtgaaagcaagcgttaatagcgcgatgagtcagtgagtgcagacccgaaaccgggtgacctatccatgtccaggttgaagcttccgtaagaggaagtggaggaccgaacccacatccgttgaaaagggtggggatgaggtgtggatagcggagaaattccaatcgaacccggagatagctggttctcctcgaaatagctttagggctagcctcatgagagtcttatggaggtagagcactgaattgcctagggggcgtcaaagcttaccaaagcatatcaaactccgaatgccatcaagatgattcatgggagtcagaccatacgagataagttggatggtcaaaagggaaagagcccagacctacagctaaggtcccaaagtacgtgttaagtggaaaaggatgtggggattctaagacaactaggacgttggcttagaagcagccattcattgaaagagtgcgtaatagctcactagtcgagagtccctgcgccgaaaatgtccggggctgaaacacgacaccgaagcttaggaatgtgtaaacattggtagaggagcattgctggcgggatgaagccataccgtaaggagtggtggactgccaggaagagagaatgccggaatgagtagcgagatgaaggtgagaatccttcaggccgaatatctaaggtttccagagtaaagctgatctgctctgggtaagtcgggacctaaggcgaggtcgaaagacgtagtcgatggataacaggttgaaattcctgtaccgcatataaacagaactgtggggacacagacagggaatggaatccgggagtggagatcccggtgcaagcgaggtaggagtgctgttggcaaatccgcagcacgatctgaagacgtgacgcgtaccgaacataagtagggaagtccaggcccctggctgtcaagaaaagccgctattgttttatatgtgcccgtaccgcaaaccgacacaggtggatgaggagagaatcctaaggccgacgggagaagtattgttaaggaactcggcaaaatgactccgtaacttcgggagaaggagtgccatgagagtggccgcagagaaatggcccaagcaactgtttagcaaaaacacaggtctatgcaaaaccgcaaggtgaagtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacgatacacccggtgaaattgaaataccagtgaagatgctggttacctgcgccaggacggaaagaccccatggagctttactccagtttgatactgggattcggcatggtatgtacaggataggtgggagactgagaaggtatgacgtcagttgtaccggagtcgctgttgggataccacccttaccatgttggatttctaacctgtggccgtaagccggtcaggggacaatgtcaggcggggagtttgactggggcggtcgcctccgaaagggtatcggaggcgctcaaaggttccctcagaatggttggaaaccattcgaagagtgcaaaggcagaagggagcttgactgtgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggagctgtagcaggttccaagggttgggctgttcgcccattaaagcggtacgcgagctgggttcagaacgtcgtgagacagttcggtccctatccggcgcaggcggaggaaatttgataggagctgtccttagtacgagaggaccgggatggacggaccgctggtgtatctgttgtactgccaagtgcatcgcagagtagccaagtctggaagggataaacgctgaaggcatctaagcgtgaagcccccctaaagataagatttcccataccgaaaggtagtaagaccccttgaagacgacgaggtagatagggcagaggtggaagtacggtaacgtatggagctgactgttactaatcggtcgaggctttaaccaaagaaggctgaagtgtaagagatgtagaaagattcttgtatgttgttttgaaggtatatcctttatatatagatttaataatgaaattcagagcattcttagagataaggatgctttttttactttataggaaagttcgcctttggctcctttccaaaagaaaaatagcccacataaaagtgggcagagcaaacagatgatcatggttttagaaaatataaaaaccttcttcaccaaaatcatcactaaacacatcttcatttagaaaataatccatatccagcaggtcatcctcgctcatatggcgaatgtcctcggatgtcataccttttgggggatttgaaatatatttttcgcgtagctctttgatattctttttcatggtagggttcctcctttatatgaggattatagcataaaaagaagtggtcatgcagaagaacgctttccacgggagcgggacattgctttctcgtataattcttcaagaggtacgcggcgatggttatgatatatttctaggatcaccatctgttgtttacaatgaggacagatcagaggatcatagccaaaagaagaaaggatcgcagtacgccaccggttaaaacaacggaaagtatgccgtttttctttcgaaatagcgagatggagttttttatcaatggaacgatgtctggcataaaggccgccataacggatcatcttgaaatgtttttcagggatgtgccggataaggcgtttgataaaatccatgacaggaatggtttcttgaacgtattgatcatcttcgtgacgattgtaatggaaagagacaagatcaccggtataagaatcgaccctggaagtggcaatgacagggcgaccaagataccggccaatatatttggtaacagtcttagggtcacaacggttgggtttggcataaacatagaagccgtgttcatgttccagataacaacgggcagaaactttttaaaaagaaggaccgatgcggagcaacatttccttgaggagagcagtacggaaagcattgcgaaggaaagtatagttgaaatgagagacattacgccagaaagcatcatcactgtaaccgccttcagagatgagacaatggatatgaggattccatttaagatccctgccgaaagtatgcaggaccatgataaaaccaggggtaaagtttttgtgtttgttcattttagagaataagcgaaggacaacactggagacggaatgaaagagacagttaaggagagagcgatcctgcaggaaaaaatcacggagggacgcatcaatggtaaaaacgcaatgacggtgtctgacattaacgagcttaaaggacatagaggtagtgcgatccatggaatatttattaccgcaggtagggcagaaacggctgtgacaacggaaaggaacaaacttgagatttccgcagtggatacagccatacatggcaccaccataagaaggatcaccacagttgatcatcttatcgatattttccatctcagcaggtctgggatgaagagtatatttgatttcttcataatgatctgtaaagatctcttgtaggatattcatgattctattatgaaggaaaaagacaaaaaaagaaacccacccctcaagaatgaggggcaggggagttgaagtgtcgaagacacttttttatttcatagaaaataccatcatgatataataaaagcaggattagaataagactgtgatgacataaggagaaaaatcatgattgcgaattcaagatgtattgcatgtaatctttcgaaaaaagaagaaaaaattcgaaaacattcagatgaaaaaaagaaaaaggaatttattcagaaagttacagggattttatataaatatggggatatagaatcaacaccaatgttggataaaagaattcaggacatttataatgaatattatgaagaggaaacggattatatagcattaaaacataaatataatcaatatatgttggaaagagaagacgagatcaaagagcatttgaaggaagcaaaggatataaaagattatattaaatatgtatgtgttggaaattatatagattttggtgtcactggaaatatagatgatcagatgttagatgatttattgaagaaagttgatagtctaaatatacctgaacaagaaattaaatatctggaagaagaattaaaacaagcaaaaacgcttttgtatatcacagataattgtggtgaaatcgttcttgataagatttttattgaggaattaaaaaaacgttatggaaatcttgaaatcacagttatggtaagaggtggtctggcaattaatgatgcaacgatagaagatgcacaagaaataggtcttacaaagattgttccagttatcagtaatggagctgcaattgctggaacggttaaagaacagttaagcaaagaagcgagaaaacagttagacagtgcagatgtgatcatagccaaaggcatgggcaattttgaatctatgtatcaggaaggaatcaacccatattatttattcctatgcaaatgtgatttgttcacacggagatttggggtcaagttgtttgatccgatattctgcaaagaagaacgattagatataaagtaacttgaaatataaatatttgaatgttataatacagttatcgacatatgacggaaataaaatacaacaaggagaagataatatggcaagaccaacaagatgtagaagaatatgtatggaaccagcttatgatagtttttttccagatggatttttgacaggggaagaagttatcatgacattagatgaatacgaaacgatacgtctgatcgatcttgaagaatatacacagcatgaatgtgcaaaacagatgaatatttccaggacaaccacagcagagatttataaaagcgcaagatacaagatggcagacagcgttgtgaatggaaagaagcttctgatcacaggaggaaattatcagttttgcgatggcacgacatgtcctttttgtaaaaaacattgcaatagagcagcaaattccgtcagacaatcaaagattttaaaaaaggaaggtaagaaaatgagaattgcagtaacatacgaagatggaaagatttatcagcattttggacatacaagtcagtttaaactttatgatattgaagacggtaagattacatctacacagatcgttgaaacgaatggacaaggacatggagccttatcaggtttcttatcacaaggtgaagtggatgtattgatctgtggcggaatcggtggtggagcacaaattgcattagcagaagctgaaattaaattatatggtggcgtatcaggagatgccgatgaagctgtgaatgcatatttagagggaaaactagatttcaatcctaatgtacaatgttctcatcatgcacatgaacattcttgtggaggacatcaatgtggagaaaataagcatggatgttcaggaaattagaaagtactgcaaaagaataataatttacaaaaatatgtagaaagagtataatgacaataggataagacatcaagcaagttctccatctgaagatttaagcagatggagaactttgtatataaaaaagagagcaataggagaaaaatatatgagtttatatgaaatttattttagtcctacaggtggaacaaaaaaagtagcagacattatgatcaaagcaatgaaaaaagatgcacaagagattgatatgatcaaagatccagataaaatactacagacagaattttcggaagatgatatctgtctgatcgcagttccttcttatggaggtagaattccatctgtgacagttgataaatttcaaaaattacaagcgaaagggacaaaagcaatattggttgctgtattcggaaacagagcgattgatgatacattagttgaaatgcaagatattttagaaaatgcaggatttgtttgtgtagtaggagttgaggcagtagcagaacattctctgatgcatcagtttggaactggacggccagatcaacaggatgagaaagaattgattagattttcagaacagatcatgcaaaaaatagaaacaaaaatggagtgtatgaaggtagaactaccaggaaatcacaattatagagaatataatggtgtacctttaaaacctgttgcaaatggcaaatgtacttcctgtggaatttgtgcaaaagaatgtccagcaggagcgatttcaaaagatgatccaaaagtaacagataaagagaaatgtatttcctgtatgcattgtgtagcagtttgtcctcaaaaagcaagacattgtaataaagtaatggaattgatcgcgagtaaaaaaatgaaaaaaagctgttcagggagaaaagaaaataagttgtatttataagaatatattgatccggaggaagaaaatggggaaaagattagcagtaatatttccaggaataggataccattgcgataaaccaattttatattattctagaaagttagcgaaagagcaagaatataaagaaatcatctcattagagtattcttacactgaaaaaaatattcgaggaaatgagaaaagaatgaaggaagtatttgatgttttatatcaacaggcagaaaaactattagaaacaattgacttttcaaaatatgaaaacgtattatttatttcaaaaagtgtaggtactgctatatcatctgcatatgcacagaagcataagattcggtgcaagcagatcttatatacgccattagagcaaacatataaatttgaacatccagatgcaatcgcatttcttggaacttccgatctatggagcaatacagcaaatgtaaaaatgctttcaaatgagcagaatgtaccaatatacatgtataagaaagcagatcattcactagagacaggagatattataaaggatatagagattttagaagatgttatgaaaagaacaaagaaatatttgtgaaaaacagcttgacatacaatatgtgttcatgataatataatcaacgtcgctgaaatacgacaaaatataacatatcatagatgaaataagttcttgacaaggagaaaataatatgatattatgtaaaagttactgacggagaacgatcagaacgatacataataaatatcatcaaaaaacttcttgacagacaaggggatagatgatatgatataaaagttgttgcagagcagaagagctcagaacaacaaaataaattaaaaaagttcttgacaaacaaaaagaactatgataaaatagtaaagcttcttgcacacaagaagcggatcacaaaaagatctttgacaactgaacaataagacaaccttgaaaattctaatgaatttttcagatgattttggtaaaaatcaacgaacgttctttataagaacagtaataacaaggataaagaagctagtgcttcttgaacttggatcaacattgaacatgagagtttgatcctggctcaggatgaacgctggcggcgtgcttaacacatgcaagtcgaacgaagctgcttaactgatcttcttcggaattgacgttttgtagactgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaagaagaagtaaaggttgttttattgttgagctgtcaaaggcttaaaactgaatattccggtggcgatgcgcgtcggggtcacacccgttcccatcccgaacacgatggttaagactgacgcggccgacaatacttggctggagacggcccgggaagataggtggctgccggatctataaaagagttttgctcttatcgatgattcgatctaagaataaacattcttggatggcatggtcgataagaccagaagtgtcgaagatacaggatattgtttctgaaacacggatgtaccttgaaaacttcatacaagaattaagatagaattcattttcagaaatggaaatgagtcaagacatcaaagaaattcaaatttcatcgttaataacgagataggaaaatgaaaaaaacacaaagcccgctgatgtaacgctatacatcagtgaggaaacagagaatcaagagattcgatcgttcctgctacggttaaagtagtaagggcgcagggtggatgccttggcactaagagccgatgaaagacgtgataagctgcgaaaagcttcggggaggagcacatatccaatgatccggagatatctgaatggggaaacccggcagaggaaacctctgtcagcgtgcagtgaatacatagctgtacgtggggaacctggggaactgaaacatctaagtacccggaggaagagaaagaaaatttatcgatttccaaagtagcggcgagcgaaatggaaagagcccaaaccgtgatgcgtgcatcgcggggttcggactgcgttgtggcagacgtaagataggagaacggactgggaagtccggccggagagagtgaaagcctcgtatccgaaatcccaagtcgcttagcaggatccagagtaggacgagacacgagaaaccttgtctgaacgagcggggaccaccccgtaaggctaaatacttcttagtgaccgatagcgcatagtactgtgaaggaaaggtgaaaagtaccccgggaggggagtgaaagagaacctgaaaccctgtgtctacaagctgtgggacctctttatatgagggactgcgtactttttgtagaacggtccggcgagttgtgcgtactggcgaggttaaggacttaaggtccggagccgaagtgaaagcaagcgttaatagcgcgatgagtcagtgagtgcagacccgaaaccgggtgacctatccatgtccaggttgaagcttccgtaagaggaagtggaggaccgaacccacatccgttgaaaagggtggggatgaggtgtggatagcggagaaattccaatcgaacccggagatagctggttctcctcgaaatagctttagggctagcctcatgagagtcttatggaggtagagcactgaattgcctagggggcgtcaaagcttaccaaagcatatcaaactccgaatgccatcaagatgattcatgggagtcagaccatacgagataagttggatggtcaaaagggaaagagcccagacctacagctaaggtcccaaagtacgtgttaagtggaaaaggatgtggggattctaagacaactaggacgttggcttagaagcagccattcattgaaagagtgcgtaatagctcactagtcgagagtccctgcgccgaaaatgtccggggctgaaacacgacaccgaagcttaggaatgtgtaaacattggtagaggagcattgctggcgggatgaagccataccgtaaggagtggtggactgccaggaagagagaatgccggaatgagtagcgagatgaaggtgagaatccttcaggccgaatatctaaggtttccagagtaaagctgatctgctctgggtaagtcgggacctaaggcgaggtcgaaagacgtagtcgatggataacaggttgaaattcctgtaccgcatataaacagaactgtggggacacagacagggaatggaatccgggagtggagatcccggtgcaagcgaggtaggagtgctgttggcaaatccgcagcacgatctgaagacgtgacgcgtaccgaacataagtagggaagtccaggcccctggctgtcaagaaaagccgctattgttttatatgtgcccgtaccgcaaaccgacacaggtggatgaggagagaatcctaaggccgacgggagaagtattgttaaggaactcggcaaaatgactccgtaacttcgggagaaggagtgccatgagagtggccgcagagaaatggcccaagcaactgtttagcaaaaacacaggtctatgcaaaaccgcaaggtgaagtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacgatacacccggtgaaattgaaataccagtgaagatgctggttacctgcgccaggacggaaagaccccatggagctttactccagtttgatactgggattcggcatggtatgtacaggataggtgggagactgagaaggtatgacgtcagttgtaccggagtcgctgttgggataccacccttaccatgttggatttctaacctgtggccgtaagccggtcaggggacaatgtcaggcggggagtttgactggggcggtcgcctccgaaagggtatcggaggcgctcaaaggttccctcagaatggttggaaaccattcgaagagtgcaaaggcagaagggagcttgactgtgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggagctgtagcaggttccaagggttgggctgttcgcccattaaagcggtacgcgagctgggttcagaacgtcgtgagacagttcggtccctatccggcgcaggcggaggaaatttgataggagctgtccttagtacgagaggaccgggatggacggaccgctggtgtatctgttgtactgccaagtgcatcgcagagtagccaagtctggaagggataaacgctgaaggcatctaagcgtgaagcccccctaaagataagatttcccataccgaaaggtagtaagaccccttgaagacgacgaggtagatagggcagaggtggaagtacggtaacgtatggagctgactgttactaatcggtcgaggctttaaccaaagaaggctgaagtgtaagagatgtagaaagattcttgtatgttgttttgaaggtatatcctttataatttaataaaggggcatagtttcaatggtaaaacatcggtctccaaaaccgcagttgggagttcgagtctctctgcccctgttacgaaaacagattgaattttatttagtctgttttttcttttataggaaaagaaagcgtatgtcagattttaccctttgaattttagcaagattactttgtgaaatgttacaaaaatattacggaatactacaaaaccactttacaaaagaagaataatgtgttaaatttaataaatgtaacagaaatgtaacaaaatatcaaaggtagaattgaggcagaattatgataaagacaataaagaaagtagctgttataataatgacagtcgtaataatgatatcgacagttacgatagctgatcaagcatcgtcgacaaccgttcaggcagcatcagggtacagtggaaagatttataaacactggtgcaaattaagaacagcaaagtctaaacgttctaaaacaatcaagaaactaagtgtaggaacaaaagttacagtattatcaacaagtggaagctggagaaaaattaaagttggtaacaaaactggatatgcattaaaaaagtatgtttatatcagtacaaatgcaccaaaacttacgggaagtacttataacaaaggacaaaccgttgcaagttttgcacaacgatttgttgggaatccatatgtatggggaggaacaaacttgaatacgggagcggattgttcaggattcgtaaaaagcgtctataagtcatttggatataatcttccaagaagttcatcctcacaaagaagtgcaggacgtaaggtttcttacagtaataaacagccaggagatctgatctgttatagtgggcatattgctatttatataggcaatggaaagattgttcatgcaagttcaagaaaaacaggaattaagatttcaccaaaggctaattatcgaaaagtactttctgtaagaagaattgtaaaataattaagaaagcaggataagatatgagatatgaaggaatgatctatcggccgccaagtgaagcatacagtctgatcgtacaggtaacgatcggatgtagtcagaatcgttgtattttttgcagcatgtttaaagaaaaacgatttaggatcagaaaagtagaagaagtcttagaagatttacaagatgcaagaaataagtatcgatatgtagagaagatttttttggcagatggagatgcattgatttgtaagatgacagatcttgaagcaatccttcattttatcaaagatcaattcccagaatgtaaacaagtaactttatacggatcgccaagaagcattttgatgaaacaacaagaagatttggataaattaagagaacttggaatatctatgatctatatgggattggaatcaggaaatgatgaagtccttacatatatgaaaaaaggtgtaacatcacaagagatgatagaggcagcacagaaagtaaaacaggcaaagatccgtttatctgtgacagctatatcagggttaggtggaagacggctatggaaggaacatgcaaaagatacaggacttgttttatcccagatgaagccagattatataggattgcttacattaatgatagaagaagatcttccgttagcagataagatcagaagcggagaatttgaactgttaaatccatatgatattttgatcgagacaaaagaaatgttaaaatatatggattgcccagattgtattttcagatcgaatcatgcatctaattatgtgaatttaagaggaacattaaatcaggataaggaagcaatgatcaatctgttagacgaggcaatcaaaggaaatgttcatttgaaatcagagtggatgaggggattctaatatagctagaatcaaggaacgagacaataggaatattatgagcctattgtttcgttcctttttatgcagagaaactcataacttaatgaattcaggtttcttatctcgaaagacggtataataacgaattccaagattagacagaaaatcaggtaatttacaaaaatcataagccatatgttttggacaatggccatcagatccgatcgtaataatttcaccaccaagttccatatatctttttatgatctcatgatgaggatttggatcactcattccgtatttaagtccagcagtattcacttcaatacctttaccattttcaatgatcatccttaaaatggcatctaaaagatcagaataatctctataatggaattcaaaagaaggatccttgatataacgtgcagcataatcaagatgtccatagacacaataatgattaaaagaagaaatattttttaagatatcttcaaaataatgagcaagtcccagacgggcaggatatgtttcaaaataaatcgcatcatatggatccataaaatcaacaatatgagtagaaccaatgataaaatcaaaaggctcatccttgacgaatgcagcacattgatctagggttgttggcattaatccaagttccactccataattgatttcaatctgatcctgatagtgttctttcattttaaatatttcttctttataggaaggaagatctagaaggaaatcaaatccatcaggattaacaggataatcaatatcgtgatgctctgtaaaacaaatagttttaagaccaagtgaaatagcatgtcggatcatttcttccataggagattcagaatcggaagaaaaactggtatgtaaatgataatctgcaagaatcataaaaaactcctttgtaaatagttaatataatacttttattatatacattatgacagaaaggtaaagaaaaaataaaatctatgtaaaaagttctttaaatataagagtaggtttgttaaaattatttatgtcggaataacgacaaatgaaatatatgtgggagatccaataagagggtctgtaaaaacacaggaggaatcgtaaaaaatgaatacactaacacatgtcggtaatctgtttgcgtttatcggcggacttggaatgttcctgtatggaatggatatcatggcatcaggacttcaaaagacagcaggaaataagatgaaagacctgcttggctatttaacaaataatcgtattttaggtgtacttgtaggagcactggttacagcaattattcagagttcatcagcaaccactgttatggttgtaggttttgtaaatgcagggatcatgaatcttacacaggcagccggtgttattatgggagccaatgtaggtacaacgatcacggcatggctggtatcagctaatgaatgggcgggagcgttaaaaccagatttttttgcaccatttattttaggaatcggagctttcatcatcacattctctaataagcagaagatgacacagaaagcggagattgccgtcggatttggtattttatttattggattatcatctatgtcatcatccattggagtatatcaggatagtccggtattctacaaagcatttcaggtattaggaggaaatccaatccttggtattttagtcggcgctgttgttacagcgatcattcagagttcatctgcatctgtcggtattttacagacattagcgatgagaggaatcgtaaactggagatcagcgatctttattacgttagggcagaatattggtacttgtatcacagcaatcttatctagtgcgggtgcaaataaaacagcaaaaagagcagctgtgatccatttaagttttaatgtattaggtgcagctatttatggggtgatcatgacgattttctttggaatcttcccagatcttgcaatgcagcatatatccagtacacagatttccattttccactcaatctttaacatatctgtgacgatactgttattcccatttgcgaatgcattggtaaaattatctggacttatcattcgtgaagagccagtagaagacgaagaagaagaaccagaagagaaagcattacgtcacttagatccacgtattcttgaaacacctgcatttgcagttgagaatgcagtgaaagaagtggtacgtatgggtgagatcgtattaaagaatttaaatcgtgtaacaaaagaagcaatgagtggagaaccaagacagagtaagatcgataaagttcataatgatgaacaggtgatcaaccatttagaaccaatgattacagaatatcttgtaaagatcagtcatttggcgatcacagaaaaagagatgaaagttgtcaacaatctgtttgattcgatcacagatattgagcgttcaggagatcatgtagagaatatggcaggatatctgcagcatatcaaggatatgaatgaaaatatttcagaagatgcgattgaagagcttagaaatatgaataatattgtaagagctgcatttgagtcagcaatccgtgcgattgaatttgacgataccaaagaagcaaaagaagcattatcttatgcagaagatgtatattgtacaagaaagatcatcagaaagagacatattcagagaatgaaagatggagcttgttctccagatattggtgtatatttccttgatatcatttctagtatggaaagaatcgcaggatatgcatttacaattgcaagatacattttaagtcagaatgatgaagaagaataaggaaaagttttttattcattgtgccgaagaaacgggataaaatttggtagaattgtacaaaatcgttttattgtatacatgataaaaatactaaatttcacttgaattttttgtcagtattgtttaaaataaaaaggaagtttgtcaatagattaacagattggcaaatccatcaaaatttaattaatcaagacttaggaggaatttgagatggcagttaaagtagcaattaatggatttggacgtattggacgtcttgcattcagacagatgttcggagcagaaggatatgaagttgtagcaatcaacgatttaacatctccaaagatgcttgcacacttattaaaatacgattcttcacagggaacatatgcattagctgataaagtagaagctggtgaaaactctatcacagttgatggaaaagaaatcacaatctacgctgaagctgatgctaaaaaccttccatggggagaacttggagtagacgtagtacttgagtgtacaggattctacacatctaaagaaaaagcatctgctcatatcgaagcaggagcaagaaaggttgttatttctgcaccagcaggaaacgatcttccaacaatcgtttacaatgtaaaccacaatgaattaaaagcagaggatacagttatttctgctgcatcttgtacaacaaactgcttagcacctatggcaaaagctcttaatgatcttgcagcaatcaaatctggaatcatgtgcacaatccatgcttacacaggagatcagatgactcttgacggaccacagagaaaaggtgacttaagaagatctcgtgcagcagcagttaacatcgtacctaactctacaggtgctgctaaagcaatcggacttgttattccagaattaaacggaaaattaatcggatctgctcagcgtgttccaactcctacaggatctacaacaatcttaacagcagttgttgaaggaaatgtaacagttgatgaagtaaacgcagctatgaaagcagctcagacagaatctttcggatataacacagacgaaatcgtatctagcgatatcgtaggaatgagatatggttctttattcgatgctacacagacaatggttcttccattagataatggaacaacagaggttcaggttgtatcttggtatgacaacgaaaactcttacacaagccagatggtaagaacaatcaaatactttgctgaattagcttaatttgatattggaatgaggacaggcctgtaattatacagtgtaataagactcagataaggggtccggtcttttggaccgggcccctatttttaatcaaggattgagaaaccctgatcaattaagatatgccttatggcatacaatcttaggaggaaaaacgaaacatgttaaacaaaaaatctgtagatgacattaatgtagcaggaaagaaagtcttagtacgttgcgatttcaacgtgcctttaaaagacggacagattacagatgaaaatcgtctggtagcagcacttccaacaatcaagaaactgatttctgacggtggaaaagtaatcctttgctctcacttaggaaaacctaaaggagaaccaaaaccagaattatctttagcaccagtagcagtacgcttaagcaaactgttaggacaggaagttaaatttgcagcagatgacaatgttgtcggagataatgcaaaagcagcagtagctgctatgaaagatggagaagtagtacttcttcagaatactcgttacagagcagaagaaactaaaaatggtgaagcattcagcaaagatcttgcaagcctttgtgatgtatttgtaaacgatgcgtttggtacagctcatagagcacactgctcaaacgttggtgtaacagaatatgttgacacagccgttgtaggatatttaatgcagaaagagatcgatttcttaggaaatgcggttaataatccagaaagacctatggtagccatcttaggtggagcgaaagttgctgacaaattaaaagtaattgataacttacttgaaaaatgtgatacactgatcatcggtggaggaatggcttatacattcttaaaagcacagggattagaagttggtaaatctttagtagacgatgaaaaaatcgactattgtaaagaaatgatggcaaaagcagagaaattaggaaagaatttatatcttccaatcgatacaacagtagcagacggattcccaaatcctatcgatgctgaaatcgaagtatctgttgtagcagctgatgcaattccagctgataaagaaggacttgatattggaccagctacatgtgagaaattcgcagaagcagttaaaactgctaaaacagttgtatggaatggaccaatgggtgtatttgaaaatcctatccttgccaaaggaacaattgccgttgctcaggctttagctgatacagatgcaacaacaatcatcggtggaggagactctgcagcagctgttaaccagttaggatttgcagacaagatgacacacatctctacaggtggtggagcttctcttgaattcttagaaggaaaagaccttccaggtgtagtagcagccaacgacaaataatcattgcacttaaatatttaatatttaatacactttataaacaaaatgtcaagaaagaaggatattagtcttatgcgtaaaacaatcgtagcaggaaactggaaaatgaacaaaactcctagcgaggcaaaagcattaatcgaagaattaaaaccattagtagcaagtgaaacttctgatgtagtattctgtgtaccagcaatcgatattccagcagcaattgaagctgcagcaggaagcaatattgcaatcggtgctgagaatatgtactttgaagaaagtggagcttatacaggagaaatcgctcctaacatgttaacagatcttggagtaaaatatgttattcttggacattctgaaagaagagaatactttgctgaaacagatgaaactgttaacaagaaagtattaaaagcttttgaacatggaattacaccaatcgtttgctgtggtgaaactcttgctcagagagaacagggagttacaatcgacttcgttcgccagcagatcaagatcgcattccagggagtaagtgctgaccaggctaagactgcagttatcgcttatgagccaatctgggctattggaacaggtaaagttgcaactacagaacaggctcaggaagtttgcgcagcaatccgtgcatgtatcgcagaagtatatgatgaagctacagcagaagcaatccgcattcagtatggtggatctgtatctgcagccagcgcaccagaattatttgcacagccagatatcgacggtggattagttggtggagcatcattaaaaccagactttggtaaaatcgtaaactataaataaatttgattaattaaatgatgggtccctcggatattgaatatccgggggattttttcttttttatataatggtagaattcgttaaaagattaatgaaataaaagactagaagcaagcaataaatcggtttataataagatcaagcacaaaaaagattccgagagtagatgaaaagggggcatatgatatggagaaatacaaaagaatttttgtcattgtcttagattccttagggatcggagaaatgccagatgcagccagatttggagatcatgatgtagacacctttgggcatatctgtgatatcgtgggaacattaaatattccaaatctaaaaaggcttggattgttaaatttgcatccaacaaaagaaatggaagaagaaaaacatccaattgcctactataccagattaaaagaaaccagtaacggaaaagatactatgacaggtcactgggagatgatgggacttaagatcgagaaaccatttcttacctttacagacacaggttttccaccagaattgatccatgaattagaagaaagatgtggaaagaaagttattggcaataaatgcgccagtggaacgcagattttggatgaattaggtgaagaagagattaaaaatggttcaatgatcgtatatacatctgccgattctgtgatgcagatctgtggaaatgaagaaacttttgatcttaagaatctttatcgctgttgtgagatcgcaagagagcttacgatgaaaaatgaatggaaagtcggaagaatcattgcaagaccatatgtgggaaagaaaaaaggcgaatttgtaagaacaagcaatcgaagggattatgctttaaaaccattttcaagaactgctttaaatgcattaaaagatgaagaatttgacgtaatttcagtaggaaagatcaatgatattttctgtggagaaggaatcacaaaagcatatcattctgaaagctctgtgcatggaatgcagcagaccgtggatgtatgcaaagaagattttcatggactttgttttaccaatctggtagactttgatacactctggggacatcgaagaaatccagtcggctatgcaaaagagatcgagaaatttgatgttggtttaggaaatctgttagaagttttaaaagaagatgatttattgatcatcaccgcagatcatggaaatgatccaacttatacaggaacagaccatacaagagaatacacaccatttatcgcatattcaaagtctatgaaagaaaatggaaggctagaagatcaagatacatttgcagtgatcggagctacgatcgcagataattttggtgtcacgatgccagaaggaacgatcggaatatctttattaagtcaattaaaatagtacaactgaaataaaaacaccacagaaggaaataaagatctcctgtggtgttctgtttacaatttggtatgtatattattcatctaaaatcgaatccatgaaagaaataataccagcttccacctcatctttgatttcatcataattatgaatctcatggcggtaaccagaataaacacgagtttttactgtatgtccagtatctacaagccagttggtaacttcataaataccttttccatattcaccaacaggatcctgatctccaccgatattataaatcggaagatcagaaggaatcttgccagcccattcggtaccagtgatcgctttcatcatctgaacaaaataaagcagagattgatttgtagttggccgggtaaatgcatcgaatggatcttctgcatgatctcgctgaacataaggatcagaacagatccattcattgcctatggaaatattaccacaacgttcacacatccagcccattagatcagcagtaaaggaagggtcagattcttttccttttccttcagctacagcagccaacaaggcagattcagcttccgtagcaccacggaaatgaccagctgtaccacagattgtgattcctgcaagttcttctccatattttgcagcaaaatctctcgtaataaaagatcccatgctgtgtccaaacagaaaataaggaagatcaggatacattttgctgacgatttcttttaacttatgttcatcttccatcatcgtatggaaaccagcatcaccccagtcaccccaggtatcgttatacattgcagtttttccatgtccaacatggtcatctgcagcaacgatataccctgcatccataaattttacgatcatatggaaataacgacgggaatgttcaccaaagccatggatcacctgtacaattccttttggtttgcaggcaggtacataaacccaaccttgcacctcatcacggccattaaaggaatgaaaactaacttcatgaagcatactaagcacctccaaatctgtaaaaactaatatgcaagcaaagaaaagacgaatcaacatattagttatataaaattgtatctgaatatattatactccagattaaaatgtacgtccataaatacaatcatataatagttgaatttcaagaagaaaatcgttataatattaacggacataaaataagattaatttttgggaaatgaaggagaaaataatgagtaaaaaaccaacagtcctgatgattttagatggatatggattaaatgaaaacaaagaagccaatgcagtagcagaagcaaagactcctgtaatggataaattaatgaaagaatacccattcgtaaaaggaaatgcatctggaatggcagtaggacttccagaaggtcagatgggtaactctgaagtagggcatatgaatatgggtgcaggacgcatcgtatatcaggaattaacaagaattacaaaagagatccaggatggagatttctttaagaacgaagcaatgttagaagcaattgaaaactgcaagaagaatggttctgcattacattgttttggattattatcagatggtggagtacacagccacaatacacatttatatggcgttcttgaaatggctaagagaaatggtctagagaacgtatatgttcatttattcttagatggacgtgacacagctccaacatcaggaaaaggattcatcgaagaattattagcgaagatggatgagatcggagtaggtaaagtggcatctatctctggacgttactatgcaatggatcgtgacaatcgttgggatcgtgtacagaaagcatacaatgcgatcgttatgggacagggaaatacagctgacagtgcgatcgatgcaattgatgcttcttacaaagaagatgttacagacgaatttgtggtaccaacagttattgttgaaaatggtgaaccagttgcaacattaaaagaaaacgattccgttattttctataacttcagaccagaccgtgcaagagagatcacacgttctatttgtgatgataaattcgacagttttgatcgtccaaacggatacttcaagacaacatttgtatgcttcacagaatatgatgtgacaatccctaacaaattagtggcattccacaaagtagaaatcaagaatacatttggagaattccttgcacagcacggattaaaacagttacgtttagcagaaacagagaaatacgctcatgtaacattcttctttaacggtggagtcgaagaaccaaacgaaggagaagacagaatcttagtaaaatctccagcagtagcaacatatgatcttcagccagagatgagtgctccagaagttggtgcaaaacttgtagaagcgatcaaatctgacaaatatgacgtgatcatcatgaacttcgcaaacagcgacatggtaggtcatacaggaatcgaagaagcagcgatcaaagcggtagaagcagttgacaaatgcgttggagatgcagtagaagcaatcaaagaagtaaatggacagatgtttatctgtgctgaccacggaaatgcagagcagttaaaagactatgaaacaggagctccatttacagcacatacaacaaatccagtaccatttatccttgtaaatgctgaagaaggattaaaattaagagaaggtggatgcttagctgatatcgtacctacattaattgagttaatgggaatggaacagccagcagaaatgacaggaaaatccctgatcgtaaaataagatcttaaaaagacatcttgaaagaatcaagaaaacaagatataataagaataacggcaaaggcgcttatgcagtatagcataagtgccttttttcttaaggaggtgtccgatatggatgtatacgaaaaattagaagaattacaggaaaaagcactgcatgatgacacaatacgaaagacattattaaaaacaagggaagaaaaagaaccgattcttgccttttgcaagcaatgtcaggaactaggatatgagatttatccgatggaactgatcaatgctggagaagaattttacgcaacaatgagaagaagtacgaatggtggaggagagaactcgcctaaattaagtggtgaagatgatatgtacgaattgtttatgacagcgatcaaataagtgcattgataagaatgctttgacattcatgcaagtaatattttcttaagagagattccgcaggtaaggatcaatgaactatgcaaagatacgttgcttccttatgcgaaacgattaaatattgattatgtgtgggtacatggagctgctactgtgttagaagcaacttttgcacattcattaaatatgatcggaacttcagtgcttgtcgtggagatgggcgttggaatgcgcatgacaaaagagtactgcaaacaattagtggatggtatttttgtagagatgaaagatcttggaatgtggcaaggagaagttattacaccaaaagatccgttgatcttcacggatggagaagtccactatctgaatgcgggatatgcaggaatctttcttccaacggtagaacattggacaaatgttaaaaagggagataagattggagaaattctagatccattggagagcgttgtgaaagaagaattatattcagaatgtgacggaatattatttacactaagagaatatccggttgtaagtgaaggatcactgatcggacgtattctggaaaggcaggcgtgagaatggaaaaagttttactctatcagatggattctctctacagggattcgtttaaaatttatggatatcattttggaggaaatgaaaaaacagtctgcattgtaggtgcgatccgtggaaatgaaattcaacaattatatatgtgttctaatctgatcaaaacgttaaaattattggaagaaagaagatgccttgatgagaatcttggaattatgatcgttccttctgttaatccatattcactcaatacaagtacaaggttctgggcaacggataatacagatatcaatcgaatgtttccaggatatgatctgggtgagacaacacaaaggattgcagacggatttttccaaaaagtaaaagattatacttatggaatccattttacaagcttttatctggaaggaaatttcactccgcatgtcaggatcatgaaaacaggatatgaaaatgtagaagtggcaaaagaatttgcaatgccatatattatgttaagaaatccaaaaccttatgatacgacaactctgaattatgaatggcaggtatggggaacacaggcattttcgatttatacaccgggaacagatcaggttgatgtaaaacaggcacgttacggaattgatgcagtgatccgatttcttgcatatcatggactgatccatatgaaggtgaatgggggataccgttcaaggatcgtagaagaaaatgaacttgtaacagtaagaacaaagacttcaggaattcttgtcttgaaagtaaaatgtggagatcatttaagtgtaggagatgagatcgcagagatcatagatacctatgaaggagatgtgatcgaagtgatcaagtcgccatgcgagggatgtttgttttatcatggatccaatccattgatctactcgaatactgcaattgcaaagatcataaaggatacagattttatttaaatgaatcttgacgtataaaataaactctgttaaaatgccacttagtgataaagtaaaatatgatagggcattgcgtatgcaatgctacggtttggacatccataatccattttaagtaaggattatggatgttttttggcctataaaataagatttggaaaggagtttttatggaaaactatttatttgaaaaaatgtcagttccaaaggcatatatgaaacttgcactgccagtggtattaagtatgatcgtatcattagtatataacatggtagatacctattttatcgccctgacaggagtgcaggaactggtcgccggagtgtcactcgtagcaccgatgtttaccttaatgatcgcatttggagatatcttcggacttggaggaagttccgcgatttcaagattgttaggagagaagaaagataacgaggcaaagaaaacatgcgcattctgtatctggatatctttggtatttggactatgtatcagtgcaatcctattattattccgtacacagattctcggattattaggagttggcaaagatacataccagtatgccaatgcctactacacatggattgcgattggtgcagtatctatcattttcagcatggtgccaagcaatatcctaagaaccgaaggattagcagtccagtcaatggcaggatcaattattggttccattgtaaatatcatctttgacccaatctttatctttggattaaaccagggggcagcaggagccgccatggcaacagttcttggaaatatcattgcagatatttattatgtatatgcggtgatgaagaaatcaaagagactgacatgttctccatcccatatgaaggtcacaggaagaaggatcagagatatcttaatgatcggaattccagcatcgatcacaaatatcatgcagacctttatgatggtcatgaccaataattttttacttacatatggaacagataaagtcgcagcgatgggaatcgcattaaaggttaatatgatcacagccttagtactcgtaggatttgccttcggaggacagccgctggtcggatacaactacggggctaaaaatgaaaaaagattaaaaaatatcctgaaatttgcatatttatttgaaatgggattaggactattatttacgattctcatgtgtattttcgcaccacagatcatcaaggtatttatggataaaccagatatcataacaaatggagccatgatgttaagattccagcagatcggaatgacctttatgtccgtgagcctgatctcaacctgcgtatgtcaggccgttggaaatgcaggaggagcttttgttttatccattagcagacagggtgtgatctatgtattagcactttttatcatgtcaaatgtgtttggatatacaggagttttggtatcacaggcgtgttcagacgtggttacagcattgatcgcagcagttattatgcttaagatcatgaaaaaacttacaaataaaaatgaataaatatacgttgcaagaagagatcaaaaaagctgacagttttaccatgtcagtttttttacaattctaagaaactttttcaaagcttcacttggctcatttgcatacattaatccataaggcagagtcagatctgtatccagaggaatcgtaacaatatgttgattatcaagatcatgcatagaaatttgtttgtgatcacaaagagggtggttcttaggaatggcacaacaaattggtgtcctgtcaagttcaagaaactgacaaagtcttttccagtcagcaggcccataaataccttcaaacagatcatatttgcttccaagaacggaaaatgtttctcctctttgctggtagtccgtcattgggagaatttctatttttaaatctggatattgcccaatttggaagcaacacaaaaacgatcataaaagatgaaaacagcatggtcatgatgatttccgatgaaactggagaaggtaagatgacagttcatcagattctgccaggtatcatgatctgttttaccgatatgcatatggaacaatgtatgtccgagtttgaattaaacagcggacagaaagttctatgcatcgaccaatgcagagaaggacgcatcgagatggaaaaccagctgggaatcttcagtattatgcgggaaaatgaactgcgggtcgatgaccgcaagcatcataaaggcatggcatattatccattaagacattatcatggcgtaagcattttcctagaagttcatgcagcacaaaaatctttagatgagatgtttcatggtttttccattgatctcaagccatattacgacaaaacacagatggaaaagatccgtgcgatccatgagcagattacatcaaatttacaagtgagagtcacaatcgaagaattgtcaaaacaatacgatatgccagcaacaagcatgaaaaaatgttttcgtgaaatttatggagattccatttattcttaccagaagagataacgtatgaatgttgcagccaatctgttaatggaagattccaaagtagagattcaagaaattgcattgaaaatgggatacgaaaatccaggaaaattttcatccgcatttaaaagcgtgatgggcgtgacaccagccaaatatagaaagcattaaaaagatcagcaaatcggtcattatttttccagaagttttttaatatagtatctggtttgattttatttaatttagccatagccgcagctcaccttatcgaacgtacgtttgtcatgtgaggtaagtataacataaataaagagaaaataaaatatattgacaaaaaaatataaataaaatataataatataaactttataaaataaaggaactttaaaaacaaaaggagatagagaagatggacaataaaacatacgaagaagattttaaaatgattcgatcagcaatcgatggagcaaagaatccaatgaatcaattaggtggattttttaaaagctatgcaattattaatatgataaccgttgtgttgtatttaatcgtcagtttatatcaaggattcgtgagggaaatgtatattgggagaatgatatgttttgtttatttggcgtattatattttccgaatgtacaaagaggaaaaaagcaatactaatcattattatcaggcgatgctttatatttatggaagcgttgtagttgtgatcccagtcattttatggattgcaggaattatcggatcatttacattaaataatgaagcttctcaggcaggaaaaatgttagaaatgttgatgaatttacaggtgttttcagcaattatcttattaagtgtatcatttttaatcgtcagttttgtacgtgataacaaaatatatgctgtatgtgcgataggtaatttagtcgtttacctgattgcgtttgcgatagatcaggaattatcaattggaaatatcgtgatacactatcaagatttgtattattatgttatgcttattattggctatatgatattagcaaaatgtataagaaaagaatgattataaatgaaagaggatatgttacagggtgaaagaatatcaaatacaggaagcattttgttcaaaactcagactactgatcatcagtcatctgatcacaaaaaaattgctttttacagaactaaagaaattaacaaatgcatcggacggtaatcttagtatacagctgaagaaattagaaagctgggaatatgttaaatctgaaaagaaactaatgaatgggaaagcggtaacacaatatgaaatcacagagatgggaattcaacagtttgaagaatatgttgattttttggaatctgtgattaagggtaaaggtatctaatatcagaagcataaaagtgtatttgaattaaaaataaaaatccgctatacttaagacaaagtatagcggattttgaacatttcgtggaggtttatatggtaaatactttaaaactgccagtaggaatcgatagttttgaaaaaatcagaaagaatcggttttattatattgataagacaaagcttatagaacagttggtggaaacaggtggcgaggttactctttttacacgtccacgtcgttttggtaagaccttgaatatgagtatgttacgctctttttttgaaatagatgcagacgaatcattgtttgatggattatatattacaaaaaataaagaactttgtgaagagtatatgggaaaatatccggttattttcctttcattaaaaagtgtggatggattaacttttgaggatgccaagtatcgcatgacagagttgataggtctagaagcagagcggtttggatttttggaagatagtgaacatctgtcagaaaatgagaaaaaacgatacaaagctattatttcattaaataatggtatgaatacaatgaatgaaaaaatgctgatatcaagccttcaggttttgtcgcaattattgtacaagcattttggaaaaaaggtgatcattttgattgatgagtatgatgtccctttggataaggcttttcagaatggcttttacagagagatggtgtcattgatcagaggtcttttcggaatggcgttgaagaccaatgatagtttacagtttgcggttttgacaggttgtatgcggatttctaaggaaagcatctttacaggtcttaataattttgaggttttatcaatcttgaatgatcagtatgatgagagttttggatttacagatgctgaggtcaaaaaaatattgaatgattacaatcttaaagatcattatttagaagtcaaagagtggtatgacggttatcattttggaaacattgatatatattgtccatgggatgtaattcaatattgtaaaagcttatatttagatgtttctgctaagccacaggatttctggtccaactcaagtggtaatgctatcgttcgtagatttatagacaaggctgatatatcgactagaaacgagatagaacgtttaatagcaggagagagtattgaaaaggatgttgtatcagaactcacttatgatgagattgataaaagcattgaaaatttatggagtgtgctttttacgacaggatatctgacacataaaggttgtacagaaagtggaaaataccgtctggtaattccgaataaagaggttagaaatcttttcgtaaaaaaaatcagagagtggttttctgatgtatcaagaaatgatggaaaaacattggaagagttttgcagtgcatttgtagataaagattccgaaaagatagaacagatttttggagactatctctggaataccatcagtatacgtgatacagcagttgcaaaagaaaagaaggaaaatttttatcatggtattttgcttggacttctaggatataaatcaaactggctgatcaagtcaaatgcagaatcaggaattggttacagtgatatattagtggaggttccgaccaatagaacaggaattgtgattgagataaagtatgcagaggacggagatctggatgcagcatgtgaaaaggcattaaaacagattgaagagaaagattatgtggcaaaactaaaacaggatggtatgaaaaattttatcaaatatggaattgcttgttttaagaaaatatgcaaagttgtagttgaatagtaaattgtagtttgaagacagaaattattggtggaatattataaaaagagatcatgtgcatgcaacccactcgcgttcggactcccacgtagctgtactaagcttctgaatggtctaacgaccatccactcgctaagtgcagacgtgtccgtacggttgctgacacatgatctctttttataatattccaccaataatttccgtcatcaaaccagcaaattaaaatttctatgtagtatcatataataattccgtatatataaccagatgatcatcaaaataaacaaaggaagggcaaggatatggaagatcaaaagatcatagatctatatacaaaccgtgaagaaagagcaattcacgaaacagataaaaaatacggacgattatgtacaagcatttccatgggaatcttaaacgatatcagagacagtgaagaatgtgtcagtgatacatggcttaccttgtggaatcagataccgcccaagaaaccgaatccattcaaagcgtatatctgcaggatcataaaaaatctatcattaaaacgatatgaatatcatcatgcaaaaaagagaaacagccagtatgatctttcactggaagaattagaagagtgcatcagcaaagaacaaaatgtagaaaatcagattgaattacgggaattaaaatggctgatagcaagatttattgaaaatcttccaaaagaaaaaaggatcttatttctaagaagatactggtttttgcaatcagtctcagaaatggcgagagattatgaaataactccaaagaatatgtcagtcaaactgttaaggatcagaaaagagttaaaagaatatctgaaagaggagggatttgaaatatgaaagacaataaggatgaggaaaaaacattatttcaggcaatcgatgcagtggatgataaatttttgatggaaacattgaaagatatggaaaagagaaagaaccaaaaccacaaacagcaattaaaatttaagcaaatgacaccaatggttaaagcagcaacgattgcattgatctgttttctgaccttaggaataagtgttagcgtggcagcagcgacatcgaaaacatttcggcagtggattcaaaagacatttatgtcacagacgatatataaagtaacacaaaccaaagatgtcagcgatcataagaaaaaccaaaagattgtgctaaaagataacatggaaatcaaacaaggacacaaccaaagctttatctgtcagtatcattacgaaggaaaatacgatgtcgaagtgacagacaaagtatatacaattgaagggaatcatttaaaagaattaaaaccagagaaaaaatggttccatggaatttataatggaaggaaattttcatttcagtatgcagtgattcgtggagaaatttatgtatacaatgtgaaaggaaatatcagtgatattttctggaaagtatgggatgaagatacgatttatgtttctttatatcatatgaataaaaaagatgatatcatacaaaaagaatgtattgcaaaattaaatcttaaaacaggaaaagtaacaaagattacagatgacaccaaaatctgcaatatggagatgtcaccagatggggaatggattttgttaaattacagaagcaaaggatattggagtgcattgaatcttaaaacaggaaaagaaaccaaacagccaggaatcagtggatatgcacacaatgaagaaatttgttttattggaaaggacaagattgtagcaatgggaaatcctgtcatgacaaaaaattctgaatacaacgtctggaataaaattaatctaaaaacagccaaagcgacaaaacaatgggatgaccgctccaaagaagaacaatattcaaataacgaatggtatgtatacaaagaaaagaaaggaaagttacatttaaaacatctggcatatgaaacatccattgatattccagatgtcaaaacagtacatattattgatgatgctggagattatgttttatttgatgatgatcaaggcaatgattatttgtgtaatctaagaaataagacatataagaaatttatattgccaaaaaaatttagagatgatacgcaaatgtatctggcaggaaaagagaagaagatgctggtgcaacatggaaaagaaatatatttgatcgatattagtgatatgtataaaaacatccaaccaaggaaataataccactattattttcataaagaaggatgtgacaaaaattgaaaaatcgtttatgcattgaaaatgttatcggaagggaagttttagattccagaggaaatccaacggtagaagtcgatgtacttttagaaaatggagccttgggaagagcgattgtcccttctggtgcttccacaggtaaatatgaggcgttagagttaagagaccgcgaaaaaagatatcgtggattaggtgttgaaacagctgttaatcatgtgaatcacaagattgcagaccgcttgactggcaaaaatgcactcaatcagattgagatcgatcagatcatgttagaagcagatggaaccccaaacaaagaaagatttggggcaaacgcaatccttggagcatcacttgcaactgctaaggcagccgcttgtggactaggtttaccgttataccagtatctcggaggcagctttgcatccaaacttccgataccaatgatgaacatattaaatggaggaaaacacgcagataataccgttgattttcaggaatttatgattgcaccagttggtgcagactctttcaaagatgctttgatgatgggaactgatgtgtatcatacattaaaatacattttgaggagaaatcatttaaatacaggtgttggagatgaaggaggtttcgccccgaatctggaaagctcagaacaggcattagatcttttggtgcaggcaattgaacaggcaggatataaaacaaaagaagaaatagcaatcgctatggattgtgctgcatcagaaatctataatgaagatgagaaagtttatcattttatgggagaaagcaggatggcaggcaaggaagtaagaagaaattctgaagaaatggtgcagtattatgaaaagcttgtcgaagattatccaatcttttccattgaagatggattaaatgaagaagatatgccaggttggaaagtattgacctaccgtcttggagagaagatcctgctagttggagatgatttatttgtaacaaatgttgcacggctaagagaaggaattaaggaaaatattgcaaacagtattttgatcaagccaaatcagattggaacattgacagagacattagatgccattgagacagctgcaaaatcaaactacaaaacaatcatttctcatagatcaggggaaagcgaagatacgacgatcgcagatattgcagttgcaacgaatgcaggactgatcaaaacaggagcaccatgcagatctgatcgtactgcaaaatacaatcgtttattacgtattgaagaagagcttggaagcttatcaaaatatggctggtaaaaggataaaaatgtaaaaactatgcaaagtattgttgttttccttgcaagtttgatatgtatatgttagaatgaaccacagtgaatggaaatatattaggaggcatatcgtgaaaacagcattaactgtaatttttattatagcatcaattttattaatcatattagtattaatgcaagaaggaaaagaagcgggattaggttctttaaccggtgcagcagatagcggaacatactggagcaagaacaaaggtcgttctaaggaaggaacactgatcaaagtgacaacattctttacgatcgtatttttcgtaacagcagcaatcctttgctcaagatttatttagagaaaagataagcacttcttaaacttgttttaagaggtgctttttatgtcgaagagaatttccataaaaagattaagaagatttaaatatacaggagaacgtaatgacagataaacgatttaacagaaagaagaaaattaaagcgttgatcaacgatccgtattatcagccaatgaaacaaagagagatcggatacctgatgcaggtagctccagaagatcgtgacgagtttgttgagattttgaatgaactggtagaagaaggatcgattgaagtaagtaaacgtggaaaatacatgccgccaagtgtgaaaacggtcaaaggaacattcagttgtacaagcaaaggttttgggtttgtgactgtggaaggggaagatgacgattattacattcatgagaagaacatgaatggagctttccatgaagatacggtcttaatgcaggtattggacgatcatccaacttctggaagaagaaaagaaggaaagatcatcaagattttagagagaggaatcaagacagtggtcggaactcttcagaaaaaccagaactttgggttcgtgattccagataatttaagatttgacagtgatatttttgtatccaaatctcagtgcaagaatcttaccagcggatttaaagtgatggtagagatcacagattatggagatgccagaagaagtccagaaggaaagatcattgaagttttaggacataaagatgatcccagagttgatattttatcaattgtcaaagcttatggaatcccaacccagtttgaagatgatgtcaaacagcaggttgatacgattccatcacagatcaaagcatctgactacaaagatcgtatggatatcagagactggccaatggtaacgatcgatggagaagatgccaaagacttggatgatgcgatcacattatcaagaaagggaaagaattatttacttggagtacatatcgcggatgtatccgaatatgtaacagagtactctccattagataaagaagcgttaaaacgaggaacaagtgtatatcttgtagaccgtgtgattccgatgcttccacatcaattatcgaatggaatttgttccttaaatcagggatgcgacagactggcattaagttgtatcatggaagttgattcaagtggaaaggttgtcgatcatcagatcgcagagacattgatcaacgtcgatcatcgtatgacatatacatccgtagctaaaatcttggatggggatatggaagaacgtaacaaatacgaagattttgtagaaatgtttgagttaatgaaggaattatccgacattttaagacatcgtcgtcatgaaagaggaagcattgactttgacttcccagaatctaagatcatcttagatgaaaaaggccgtccagttgatgtttatccacaggtaagaaatgcagcaacaaagatcatagaagattttatgctgtgtgccaatgaaacgatcgcggaagaattttactggagagagattccatttttgtatcgaatccatgagattccagaccatgagaagattgataagttacaggtatttttacaaaactttggaatttacttaaagagcagtcatgatgagattcatccaaaggaagtacagaagttactgacaaagatcgaaggaacaccagaagaaccattgatcagccgtttgacattaagatctatgaaacaggcaaaatattctgcatacagctctatgcattttggattgtccacaagatattactgccattttacatcaccgatccgaagatatccagatcttcagattcacaggatcatcaaggaaactttgcataataaatttataacaagacgattcagtcattacgatgcaattttgccaaaagtagcagaacagtcatctaagatggaacgccgtgcagaagaagttgagagagaagtatgtaagcttaagaaagcggaatacatgagaagaagaatcggagaagtacatgaaggaatcatttccggtgtgacaaactggggaatctatgtggaacttccaaatacgatcgaaggaatggttcatgtatccattcttccgggcgactattattactatgatgagaagacctattccatggtaggagaaagaactggaagaacatttaaattaggagagaaggcgaaaatccgtgtcaaagatgtggatatgatgcttaagaatattgattttgagttagtggaggatgatgattatgagcaaagcgaagacggatggaattaaactcatagcaaataataaaaaagcaagacatgattattttgtagaagacagttttgaagcagggatcgtacttcatggaactgaagtaaaatctttaagacaaggacactgcagcatcaaagaatcctttgttgatattgataatggggaagtgttcattcatcagatgcatatcagcccttatgaaaaaggaaatatcttcaacaaagatccacttcgtacaagaaaactattattgcataaatcggagatttccaagatgatcggacagatcaatcagaagggatatacattgattccattaaaagtatactttagtggaagtttggtgaaagttcagatcggattatgcaaaggtaagaaactctacgacaaacgacaagatatctcaaagagagatcagttaagagaagcacagagagacttcaaagtaagaaactttggataatttcaaggaagattaaagattgtataagaagttatacaaaaagacttgacatcctatataagagactatataatataatttcgagactgggaaggctctcagtctcgaaccaagcttattaattccgggctagtaaaggtttcgacaggggttatgaagcttgaggagccattgggagggaccaccttacggtacaaacttaaatataaacgcagataataaattagcgtacgctgcctagtttgcagcagtcagctctagatcacctgtagtctggaatcctggcttcaaacatgcaggacccttgaccggtcaagctttgtgccggttaaagtattgatgaagctactgaagctgtgatcctgttagtcggagcacggtagagggaatgaaagaagactgactgtaatgggagagcctcatgtgaattggcttttggacgcgggttcgattcccgcctagtccattcttaaacctcacgtttttacgtggggttttcttttttcatgttgcattcgtgttgcaatatattttcaaggtatgcatcaatcgtatcatcaaccttgattcgttcggatgaaaaggtctgctgatatacaggcacgttcgatctgacgggaacggatctttcgctgataagctttatatttcggagaataagtgatgatcagattttcatccatgttctcagtgacaacagggttttttttatattgtagaaatgagagatgaatttgctccagatgagaacatcagacatagaccacttttattagaggaaattgataaatatgtggcagtgatcggagattcatcgaaagtttctacgattacaaatgctgtgtatgaagggtatcatgtggcgttaggtatctagagaaataaaaacatatttataagaaaaatcataaaggcattggatactttttagaaatatctggtgcctttattttgtgctataatgagaataaaaattgatagaataaaatgtaaggggaagaaataagtgaaacgatgtaaaattactgcaatccgcaaaacagaatataaagacttaatggaaaagtatgaaaatcctatggagaatgcttgcgatatagaagaggggcaagtatttattgcagaaggatggaaacgaccagaaggattttgtgaaagtgcatgggagagtatctctccgtttgttatgacattagtttatggaggcagcgatatttatgaaggatggatgaaaaataaaaaatcagcaatgatcagctgtaatgatggattccgcccggttagtttttatatcgaagtgttggaagatgaaagaagctagagttttattttaagaaggaatatggtactattgattataaatatggggtttagatgttaaattaatatgggacagattataatacaacattgagaaacaaggaaaggcggaggcacttatggcagaacagattagaaggacaaaatgagatggtgcggcaatccagatttgtaattatgagaatgtacaataattttcatttgactttttcaaaaaatcaaaatataataaaaaatgaacgagtagcaaacgagcgtaaatccagtttttgctgctcgtttttctatttttacaatcataaaatgtcattaaaaagtgtgtagccaatcagtgtaagaccagcttattctgatgaactacattctttttttatgcaaaaaaggaggaaaaattaaaaatggcagaaagtaacaagatgaaggatatgccagtcaataagctcatgatccagatgggaattccaatgatcttatcaatggcattgcaggcagtctacaatattgtagacagtgcatttgtaggtaacatgagagtgggaagtgaggcagccctaaatgccttgacgcttgtatttccagttcagatgctgatggttgcgatagggattggaacaggagtgggaaccaatgcacttcttgcaagaacactcggacagggaaatcataaaaaagcaggtaaggttgctggaaacagtttgtttttaggcgggatcatttatgtggtctgtttgctctttggaatttttggagttaaaacatacatttcatcacagacggttgatccgcaagtaatctctatgggaacaagttatcttaggatatgctgtatcatttccatgggaatcattttcttttctctatttgaaaagttgttacaggcaacagggcgttcgctctattcaacaatcggtcaggttgtgggagcagtggtaaatatcatccttgatccgattatgatctatgggattggacctgttccagaaatgggggttcaaggtgcagcttatgcaacagtcatcggacaggtagtgtcaacagtgttattgtttatctttcatatgaaattcaacaaagaatttgagcatggagcaaagtatatgaagccagatgctggaattatcaaagaaatatatgcaatcggacttccagcgatcattgcacaggcattgatgtcaattatggtatatgtaatgaaccttattttgaaattcagtccttccgctcagacagcctacggattgttttataaagtacagcagtttgttttattcttagcatttggactaagggatgcgattacaccgatcatagcatttgcttatgggatgggaagtaaaaagaggataaaagatggaatcaaatatggattgatgtacacgagcgtattgatgatctttggaattttgatcacagaaatattcccaagttcttttgcaacattatttaatgcaggaagttccagagaatattttatcggagcaatgagaattatttcaattagttttattttcgcaggaattaatgtagcatatcagggaatatatcaagcattggatggtggtatggaatcactgattatttcacttctcagacaacttgtgatcatattacctctggcaggaatcttttcaatttttgtaagaaaaggacgagcaggagtatctttgatctggtgggcattcccaattacagaacttgcagcatgtctgatcggatttgtctttttaaagaaaatccaaaaaataaaagtagagcgattaacacattaaggaggaaggtattatggcaaaaagaatcattacaatcagtagagaatttggaagcggtggacgatttatcggagaagaagtagcacaacagcttggaattgcttattatagtgaaaatattatagatcagattgcgcaacagtcaggattatcaccagaatatatcgaagaaaatgcagaattatccccaaagaaaggattttttgcctatgcattttcgggtcgtgatattacaggaaaatccgtggacgatatgctgtatgaggcacagagaaaggtaatcttggaaattgcagaaaaagaaccatgcgttatgattgggagaaatactgattttatactgaaggatagagatgatgtgttaaatgtgtttatacatggagacatgccagagaagatcaaacgtatttgcaagttatataatgttacagaagaaggggcagtaaaacttataaaggatacagataaaagacgaaggacaaattataatttctatacagaacaaaaatggggaatggcaaggaattatacattgtcattaaacagttcacagctaggatatgaaaggtgtgagaagatgatcatagattgtgtggatatttgttagattataggaatttttcttattatctcatataggaaatattttttgaatctgatatactaaaactataaggaggaatataaaaatggaatttcaaacgatgggaacaaagttatcaaagtaaacaagatgaaattcatcagataggagagtatctgcaaaagcaaggaatagaaaaaataacgcttattgtcgcttcatcgattggagcagatttaggactcacatttctttctcagatgaaaatcccaattgagcatacttttttgatggaggtcaatttgcacagatttcaagattgacaaggaaggttatggttccatttttgtatctggcgattaagagcctttattggagtaaaggagcgactttaagtaaatttatgtggtgcagtgaagaaagtataaagccatattttataaaagcaagaaaaaatctgcagtataaaaatctatatcgacagatgatggacagtttggaagataaagaatttccaaagctgtcacaagaggttcaaagaaccattttctttgagtttggaagtgtcgaggaacattataaatatcgtgatgctgtaaagaaggcgtatccgtacaggaaaattgatgagaatagttagcgaacactaatgaaagggagaaaagaagaatgaatgaaaaagcaaattatggaaactgggtacctgaaaaagcattgtatatgttatttggagcagtaattgttttaggtgttattgcggtagcagtacaagtagctttaagtgaaatggtcattgcaatcatagtaggcgtattatgcattatgactctggtaatggcaatttatatgctgatctgtcatgaagcattcgcatttggaaaaggaaatatgatggcaggagtacatgaacatctgattaaacatcttgattgggatggtgaagggaaacttctagacatcggatgcggagcagcagcacttactgttcattgcgccaaagcatttccaaaggcacagatcacagcgatggatcactggggtgtggaatggaattatgcaaaagagcagtgcgagaaaaatgcaaagattgaaggagttgcagaccatatcgcttttcaaaaaggagatgcagcaaaactggatttccctgatgagacatttgatgcagtagtaagcaatttcgtgtttcatgaagtgcgaacagcaaaagataagagggatgttgtaaaagaagcattaagagttttgaaaaaaggcggtgtattttcttttcaggatatgttttcacagaaagcattgtacggagatatggaagagtttgtaagaatcttaaaagaagaaggaatttcagaagttcactacataggaaatctggaaaagaagctagactttattccgggatttgtaacaacaccatggatgatcagcgggatgggaattatttatgggaaaaaataggacacagtcaggaaattgtgataaaatataagaaattaattaacaggttgaaagtggcttcggtatgctgcaaaagagggggcaaatccagtttaataaaattggaaattgcgagaaaggagaaaagtatgcttacaatattaaactcagaaagcttatggattggaacagacatgatacaatttaatgcgatcagggatatcttggatcgggaaaagattaagtacaaatacaaaacatacaatcacttaggagaatgggcaggatcaggaacacttcgtggaaactttggaagtgtggggaatcctacatcacagtccatacagtatgaaatttttgtggcgagaaaagacttagaaaaagcacaggctgtaatgtggaatttgcttagataaagtagatacatgatgataatgaagaaaggaaagatactgtatattactaaagtgatatacagtgccattctttttatggtataataagaatatcataaaaattcattgcagatcgcatgatgtatgttgcagattggaggcaaatatgagcagaaaaacaagaacaaaaagtaagacaagaaataatgcaaaaagcagggcaaaaaaagcaactgtttcaacagtgaaaagtacagatacagaagagactgttattccaacagcagaacctgcaataataaaagaggaagttgcacaaccagaaccaaaagaagaaatcaaaatagaaacgccagtagaagaaaatcaggttattgaacagcctgatcttggaccaagaagaagtgtcgtttttattggctcagaatgctatccatttgtgaaaacaggagggcttggagatgttatgtctgcacttccaaagagccttgcaaaattaaatgttgatgtgaaagtgatccttccaagatacaagtgcattccgtgggaatatcaagaaaagatggaatacaaaggctctttctatatggatctttgttctgatggaagacaatattatgtaggtattatggagtatcaggaagacggtgtagtttatgattttatcgacaatgaggaatttttctcttggggtaatccgtatacaaatctgattgatgatattccaaagttctgttatttttccaaggcagcattggcggcactgaattatctggactgggttcctgatgtagtacactgccacgactggcaggcagcgttggtaccactttatctaagaacatgttttgcagatacaaatgtaggacgtgcaagtgcagtacttacgatacataacctaaaattccaaggtatctacgacagaaaaatgatccaatactggtcaggacttccggattatgtattcaacaaagactgcctgactcagaactggttggatgcgaatatgttaaaaggtggaatcacttattgcaatagacttacaacggtaagtaacacatacgctggagagattcagacagaagaatatggagaaggacttgcagagcacttaagatatcaccagaataagatcagaggaattgtaaatggtattgatatcaacatctggaatccatctacagacaagttgttaaaagcaaattatgatgcaaagacagcaatcgaaaataaaaagaagaataagaaagcactacaggaatctttaggattagaggtcgacgaacacaagatggtgatcggattgatttctcgtcttacgaaccaaaaaggacttgatctggtcaatgacgtaattccaggcgttatggatggaaatacacaggtagttgttcttggtacaggtgattcctggtatgaagaagctttccgttcttacgagaatcaatataaaggaagtttttgtgcctatattgcttacgatgaaaatgttgcccacaatatctattctggatgtgatgcacttttagttccatcaagattcgagccatgcggactaacacaattgattgctatgagatatggtgcgattccaattgtcagagagacaggaggacttagagatactgtttggccatataacatgtttgataatacaggtaacggctttacatttgatcgatatgaaagcggacttctgtatgatacgatcaatagagcaaagacatgctactttgagaatagagcaagctgggatgatatggtgattcgtgatatgaataaagatgtatcatgggagacaagtgcaagacagtacaaagatatgtatgtagaattaacaccaagataaaattgtgatttgttgatagtgttgcatgtatgagtcagaaagaacaagagaagaaatatttataaaaataaagggtgacactccgcatttttgaaagcatttttacaaatcgctgattcgcgcctgttcctttgataactccctagctgcgagccaaaatgcccgcagctgcgggcagacaatcaaccacagggcgctgcgaatttgtaaaaaacgcattcaaaaagtactcatgttgtcacccttttttcttataaatatttcttcttatcttctttctgactcatacaacgaaacactattcaaaccaccacacagtgtgtatgttttactgtattggtatttataataaacactgtctaccactacaaaaattgaaaaataataacatttaacatacacccccactcaagttttccaatcttgtaattcagtgctgaaatcggaatcttttgtggtgatcgtccatggttttctcaataaggggatgacgggcatagggatagcccgtcgttattggctatttttctacatcattgaggagccaatatattatcctcatattctagataaaaagattcatacaatggactcttaacagttccgccaaagaagtaacctctgtaacctgcagttggccttttataatatttgggttttgctgttatatgatagtttatacaaattgttgtggcattttttaaagaaacctttctaccattttttatctttttggatttatttttataaaagatttcaatactgtccaccttataattcttgacagttttaacagtaatctttacttttgattttggagcagttcctttatcccttaccgtccaatggccttttgcaagagcagcataatttttggagccgatctttacacttttaaatactcgagagtgctttttgaatgttacggcacaagacaggttatagctctttccattctgttttactgtaaaacggagttttgttttttcgccatcttttacatcatgtatggaatcggaatctgatgtcgtttgtacaaaaacagcgttaagaccagctgcttttgatgcggtataatatttgttagatgattttacatttgtgattacagcggacctggataaattctttatataaatatatccatctccttctgtgggcatttcatttccactaatataagcattataaaactccagagtctgtttcttcgggcactgaggtgcctttgctgctgcgcttactgctgtaggtactgccaggattacgaaaaggcatgccaataagcttactaaaatgtttcttgtctttttcactttgatttttctcctgattatttggttttttcattttgtgatgctgttaatttctctttttccttccactcctttcccattataacgtgtccaaaagttctgcttcagctatattgtcagactttccctttgagtcgttatatttttacatcattatactaatcttattataagcggtcaatattttccaagatcataattcacgaaaatctttttcgtggttaccgttcacagtaacacgcttcgcgccgcaattctcgggttttctgtgaactttgttcgcaaaaaaaacacctcgcggaatgttacagtgaacaataacttttcgtgttaattgcaattcaaacttccacttcaggagcgtgttttaaaagaatagacggttgtggaagaatccggtacgagacggctgaaaaccaaagaagatggagctatgggttcccaaatcatgcagaatccctctgacccggatgcaacttaccgtgaaaaagaggggaaacaaaaccgtggttatacagcaaacattgtggaaactgttgaatccatggaaaaaacagaggagccaacagtgcttataacagatggggcctatagcggcagggacaatacaaacgctgcaattatatcaaccagactggacaatgcaggatatcatttccaaaaaacaaatgtgaaaactgtccacactgtgaccagtgcaaccccaagatgtttaaaggaccagtgtggtttttctgtctaaaaaatcctctgacagagcaaagacacaaaggaaaatgaagacagaaaaatataaggaattgtcccggatcagaaacggagtggaaacaatcccatccatcctgtggaggaaataccagatagaccatatgccggtaagagggcttctccccactaaactccgttttgggataaaactggcagccctgaacttcaagaagctgtttggatatctgaacagtgtgggtcagtgcgccttaattccccagatcagttaacagagcagaaacagtggtgtgggttattaccccaaaacagatctaacaatggatatttgttgttttataagaaattttcaaggaacatagatttctatgggcgataattattatgttttgacacccatatcaaatttataatttatagttggccaacttacaaattaaaatttcttcaaaagcaacggtatttccgccacaagcattccaatccatccggcaagataagaaaaacggtaatgtttcaatttgcaatgaaaaatggaacacaagaatagcagcaaagatcacacgaacagacatattcacaaaactactgattaacgtaattttaacataatatagcaagaattctcctctacaggttggagatgaattgcataaaaacaaaaagaacacttgttcgatagtacggtctatggtataatagaaccatgacattaatcatgtgcatgtaatgttccgtgcgcagccgagaacagaacttagtaaatttatcaatgcttataaaagtgccagtagcaggcactacagtagaagtgatccgtcaatacattgaaacccaggaagagaaaaagtattgaacatagcatatcgttttcggatctatccgacagaagaacagaagatacttcttggcaaaacatttggctattgtcgttttctgtacaatcagatgcttgatgataagattcgagagtatgaaaagacaaagaaaatgataaaggtagaccgtttctttccttccagtaaaaaatgctgtaaatgtggaaggataaagaaagagttgagattattcgaaagagtctatcactgtgagtgtagaaataagatggacagagatcataatgcagcgatcagcatccgtgaagaggcaagaaggatgttgacagcataaactgtccgtatccggacaatcagataataagaaaacatgcccgtgtccgggtaaaagaatcgcggggcacgcgaggatagcttgtagatacttggctcagtagagccattgagcaagaagccccacttcaaaatcagggatttaagtggtgggagcatgtcaccataatatagaaaaatatgactataataataggaaaaaatgacgatcagaaatgggagaaataacaaatgagccaaagaaaaaacaaaaaagtatactatcacctgccaggattatttgaattttatgaattatattgtgcctttctgccattatataaggaacacagagaatacttttatgactggtgtgagatcagttccatctatggctctcccgcagattgtctctggggaggtggacgtgcaggatttggatctgataatccagaagaagtcttaaaacttacacaggaatatggaatttcagccagactgacttttagcaacagtttacttagaaaagaacatttaacagataaaaaatgtaatatcctatgcaaaatgtttgaagaagttggagaaaaaagaaatggagtgatcgtccattcggatttattgcttaagtatttggaaacaaattatccaaaattatatttcgtatcttctacgacaaaagtgttgacggattttaatgaatttttgcaagaagtaaagaaagaagattttcggtatgtagtaccagattttcggttaaataaagcatttgataaattaaacatgctttcggagcaggagaaaaataaagtggaatttttatgcaatgaatgctgttggtttggatgtaaagacagaaagcaatgctacgaaatagtcagtcgaaaaaacttaggagaaatgataccagatcacaaatgcaactcgccagatgcaaaggaaggctatcgtttttcaaaggcaatgaagaatccaggatttatcagtgctaatgatataaagaaaatttatcttccaatggggtttgagaattttaaaattgaaggacgtggattgggaagtgcgttggttttggagtttctactatactatatggtaaaaccagaataccaaatatgcgttagagaagaagtttatttggataatatgcttgatttattttaatgtataatgcattttatacaacacataaagcaaaactgtttattaaaaaatgcgaggaatctaagttaagaagtttaagaaaaagaaggggtttctttttcttgtatgatttagtataatagagagatacagtgaaatatatattgaaaataggagagaaaaatggaaaagaaaaatgactttaagccttttatttccgcagataaagtattaccagagtttacagttacatcagtaatccttggtatgatactggcggttatatttggtggtgcaaacgcttatttggggctaagagttggtatgactgtatcagcctccattccagcggcagttatttccatgggtgtgatccgtgtgatcttaaagaaagattccatccttgaaaataacatggtacagacaattggttcagcaggtgaatcattagcagcaggagcaatctttacaatccctgctatttttatttgggcatcagaaaagggaagtggagttactgctccatcttttgtatctatcgcattgatcgcgctttgcggtggtattttaggagtactttttatggtacctcttcgtacagccctcatcgtagaagaacatggggtacttccttatcctgaaggaacagcttgtgcagaagtgcttttagctggagaagaaggaggaagtaaatctaaagttgtatttgcaggactcggaattgcggcagtttataaatttattgcagatggtttaaaacttttccctagtgaagttgaattttcaatgcagggacagtatacaacatccgttggtatggatgttcttccggcattagcaggtgtaggttatatctgtggtgtgcaggtatcaagctatctttttgcaggtggtgtgctatcttatcttgtattaattcctgcaattgcttattttggcggagattctttatcaaaagttgtcgatgagacaggaaaagcacttgcatttaatcagttaggtgcaagccagatctggagtaactatgtcagatatattggtgccggtgcagtagcagctggtggtctgatcagtctgatcaagacattcccaacaatgatcaagacatttggacatgctatgaagggattcggtaagaaaggtgacagccagttaagaacacagcaggatatttctatgaaagtggttcttggaggaatcctgatcattgcagttttaatctggttattaccagagattccagtaagcttcttgggagcagtgatgattgttgtatttggtttcttctttgcaacggtatcatctagaatggttggtattgtaggaagtagtaataacccagtatcaggtatggcgatcgcgacactgatcgtaacaacatttatcttaaaagcaactggaaatacaggagcagcaggtatggtatcagcaatttctattggtactgttatctgtatcgtagcagctatggcaggagatacttcacaggacttaaagacaggttatatcgtaggtgcgacacctagattacagcagatcggagaattgatcggtgcgatcgtagcagcatttgcgatcggaggagttatgtaccttctgaacgcagcatggggattcggttctgatcagattccagcaccacaggcaacattgatgaagatggtcgttgaaggtgttatgggtggtacattaccatgggtattgattttcatgggtgtgtttatcgcaatcgttgttgaaatccttggaattccagtgttagcattttcaatcggtctttatttaccaatttacttaagtacaccgatcatggttggtggactgattcgttggtttattgacaataagagaaaatatgacagtgatgcggcaagaaaagacggatcagatcgaggagtcctttatgctgcaggtatgattgcaggagaaggtatcgttggtatccttctggctgtactggcagtatttggtgttgcagataagatcaatctgtcatctgtatatggagctgccttccagagtgtaggtaactgggtaggtttagcagcttttgtagtattgttagctatattattctacttcacaagaaataaaaagacgattgaagtagacgcaaaataataaaaataaatatgtatttcagtgagaagaaagcactgctgcgattctgcagtagtgctttctaaataaaaaggtgcattatgaaagaaaagaagaattatattgacaacatcccgaagatcaatgatatgaaatgggatgtgtcagaagatggaattgtagaaattacagtagaaaatactggattttataatacgatcgcgcagaaaatatttaaaaagccacgttacagttttatcaaattagatgaatatggaagttttgtgtggcagaaaattgatggaaagaaaagtatttatgagataggaaaagaacttcaagcagttcatgaaggtgcagcaacacagttatatgaaagattatcacagtattttgcaattttagaaagaaataaatacattgtttttgaagaataaatattattaaaagtgaaaaaggatttaatatgaaaatatcaacagtgatcataggcattgctttatttgccatagtgacgatgatcctatatggatggggaatcgtaaaacaaaagaatcagacaagtgacctgatgaatttgctttttagtaaaggacaggataaaataaaaaagtatttaaaacaacatgaatacgttacaatttcacaggtagaacagatttgcgaaggtcttgaagcgaaacagccattttcaagaaataaagcggttgtgaaggataaacgagactatgcgaagaaacttgtagaatatatgctgaaaacgaatcagctcgaacaagagggcagtcgttacaaaatgcacaaaaaataaggaggacataaaatgtcagtattaggagaattacagccaaacaaagtatttaaatattttgaggagatttgttcaatccctcacggatcaagaaatctgcagcagattagcgattatctggtagattttgcaaaagcacatgaattaaaatacagacaggatgaagatctgaatgtgatcatctggaaagatggatccaaaggatatgaggcttctgaaccagtcattcttcagggacatatggacatggttgcagtcaaagaagcagattgcgataaagatatggaaaaagaaggattggatctggaaatcaatggagattatatttcagcaaaaggaacttctttaggtggagatgatgggattgcggttgcatatacacttgcagtgttagacgatgaagaaatggcacacccaccaatcgaagcaatctttacagttaacgaagaaatcggtatgcttggagcagcaactattgatgtttcagatcttaagggacgtttatttatgaacatggattctgaagacgaaggagtgtttacagtcagctgtgcaggtggagcatccgtaatctgtaagattccatatgagacagaaactgtcaatgcatctgttattgaaatcaagatgactggatttgcaggtgggcattctggtgtcgagatcatcaaagggcgtttgaacgcaaactgtgcaatggcaagagtattgttaagtctgtttaatgaggttgaaatgcagcttgtttccgtaaatggtggagaaaaagacaatgcgatcgctaagtttagcgaagcatctgttgcagtacttccagaagaattagaagcagcaaaacagatcgttgaagatacatttgcacagatcaaagaagaatataaagtcacagatccagatgcaaaattaacagtgaatgtaaaagaagcagcaaatatagaaacattcacagaagatacaacatttgcagtagtaacagcaatggttcatatgccaaatggtgttcagagaatgaatccagagattgaaggattggtacagacatcactgaatatgggaattttaacaacagaagaatctgaagtacagatgacatttgcagttagaagttccagtgagacagaaaaacagtatctgatcgatcaattaacatctcttacagaaacattaggagggaatgtagagattgcaggaccatatccaggatgggaatacaaagcagattccagattacgtgaggttatggttgaagcatataaacatttatacaacggagaagaaccagttgttgaaggtattcatgcaggacttgaatgtggaatctttgcttctaaattgccggggcttgatgcagtatcctttggaccacagatggaacatattcatacaacaaatgaggtgttgagtatctcatctacagaacgtacatgggaactggttgtgaaaacgttggctgctttgaaataaattgtgatttgtagtttgaagacggaaattattggtggaatattataaaaagagatcatgtgtctgcaacccacttgcgttcggactcccacgtagctgtactaagctcctgaatggtctaacgaccatccactcgctaagtgcagacgtgtccgtacggttgctgacacatgatctctttttataatattcaaataatttacgtgattcaaaccactacacagtgtgtatgttatacggtactggctaataatttttgtatttattaacagatgacagatggtaaaagggattaaacaacactgatttatcgaggtgtttggaaaatattcaaattgcttatcttcagtttgttgataatattattggagttgaatcttctgccattttgtattgatatattataacaagtacgattataataaaatagttgtgtttttttaaaccattttatacaataataaatagaaaaatcaaaatgaaaggaataaaatgaatccatggaagaattcttacaagtaggagcaatcgccaacacacacggcatcgctggggaagtcaaagtatttccgatgacagatgatatcaaacgatttaagaaattaaaagaagtatatttagatacaggaaaagaaagaaaactattacacgtagtgtcatgcaaattcgtaaagaaccagccggttttgagatttaaagaattttcaaatatcaacgaagtagagatgtataaaagaaaaggcctgtttgttacaagagatcaggcagtacctcttgaaaaagacgaatactttatcgcagatctgatcggtctttctgtgatcagagaggataatggagaagttcttggggaattaactgatgttttacagacgggtgcaaatgatgtctatgaagtgaagatggaagatggaaaagaagttttacttccagcgatcagagaatgcattaagaatgtggatcttcaaaaaggtgagatcacagtccatgtcatgaaaggattattagatgaatagatttcatatattaacattatttccagagatggtgatggacgggttgaatacaagtatcatcggaagagcgattgaagcaggacttcttgagatcaatgcggtcaatattcgtgactattctaccaataaacatatgaaagtggatgattacccatatggaggcggagccggacttgtgatgcagccagagccggtttaccgtgcgtataaagaccttgaaaaagatatgaagaagaaaccaagagttgtctatctgacgccgcaagggacaacatttcatcaggagatggcaaaggaacttgcaaaagaagaagaattagtttttttatgtgggcattatgaaggaatcgatgagagggttttggaagaaatagtcacagattatgtatcgatcggagattatgtattgacaggtggggagttgcctgcaatggtgatgatcgattcaatttcaagattggttccgggtgttttacataatgatgattctgctggggatgaatcttttgaaaatgggttgcttgaatatccacagtatacaagaccaccagtgtttttagataaagaggtgccagaagttcttttatccggacatcatgagaatatccgcaaatggagacatgaacagtcagtcaaacgtacaaaagagagaagaccagatctttgggaagcatatgagaaggggatggaagagaaagatggagacaggtaagattaaacttgtagcagctgatatggatggaactcttttgaatcgtgatcgcaagatcacacaatatacacagaatgtgatcaaaaaagcaatggcacaaggtgtttatttcgttccggctacaggaagagctgtgaatgcattaccgccagagttaaaagagatggaaggaattcgctatgggattttcagtaatggtgcaaccatttatgacttaaaagaagaaaaagtgatttataaaaatcattttgaaatggatcgagttttagagttgatggattttcttaagcaatttgatctaatggaaagtattagtttaaatgggcaatcctatgctaacaaaaaagaaatggaaaatattgattattatgaacttgattcaaatacaaaagcaattgtgcaggggtcgagagttcttgttgatgatttagagatgtttgtaaaagaacagtcaacaactgttgagaagacaactttattatttaagacgatggaagaaagacgaagagcagcggatgcattgagtaagattgaagacattcagttttcaagttctcttccaaagaatcttgaaatttctaagaaaggctgtaataaaggagatggtttgttccatcttgcaaagatcttgaatattcaaaaagaagagattatgagttgtggggatgcagacaatgacagagaacttttagaaagtgcaggacttgcggttgttatggaaaatggccttgattctatgaaagcgatcgcagactatattacagtttccaatcaggaaaatggagtcgcaaaggcaatggagaaatttgtattaaggtaaagaatcttaaaaaatacaaaaaaacacttgcttcacataaaaaaatatgataatatgttcaagttgttataaatatggatggtcctctgttacattaggtattaagaacatctgaatacgttcaaggaggaacaacaatgagcgcacaggatattattaaaagcatcgaagatgcacagttaagagaagttgctgaattcaaaacaggagacactgtaagagttcacgcgaaagtaaaagaaggaaaccgtgaaagagttcagatttttgaaggaacagtcatcaaaagacagaatggtggagcacgcgaaacatttactgtaagaaaacaggcaagtggtgttggtgttgaaaaaacatggccagtacattctccaatcatcgaaaagattgaagtagtaagacgtggtaaagtaagacgtgctaaattatactacttacgtgatcgtgttggtaaagcagcaaaagtaaaagaaagagtataatcagacaaagattgtcaaaagagagggataggctgtatagcttatccctgttttagtatacaggaattttacgaatctttctatacggagaggaaaggagttcttctatgaggaaaggatacacagtaacctatcagatgcgcaagaaacagcgtcagcaaagggaaatcgtgattcagtatgtcttaaaatttgtcggagttgtgttgctggcatttttgttagtaagatttgtgtgtttcagttttacgattcaaggtgattctatgtcaccaacgatcgaaagaggtgaaaaacatctggtgaatcgcctgatctatcagatcaagggaccaagcaggtatgatgtggtcatatttaaatcagatgacaagaatggaaattactatgtaaaacgagtgataggtcttccgggagaaaaggttcagatcaaaaacggcagaatctatgtaaacggaaagaaaacaaaagcattttcaaatcagaagattttatctgcaggattagcagcagatgagattacattaaagagtaagcagtactttgttgtgggagataactataataatagtgaagattccagaagtgcgagtgttggaaatatcaaaagaacaaatattattggaaaggtcggtatcaaatactggccgtggtaaacagagggaaggagaaataaagaatggattttcagtggtacccgggtcatatgaccaaagcaaaacgtatgatgcaggaaaacatgaaactgatcgatattatgatcgaacttgtggatgcaagaattccgctaagcagcagaaatccggatattgaccagttggcagcgaacaagtcacgattgatcttgttaaataagacagatatggcagatgaacgtgtgactgcacagtgggaagaatattttaaagaaaaaggattctatgtagcaagaacaaatgcaagatcaggaaaaggtgtcaaaggtacacaggcgatcgttatggatgcctgcaaggaaaaacttgagagagatagaaaacgtgggattaaaaaccgtccgatcagagcaatgatcgcaggaatcccaaacgttggaaaatcaacatttatcaacagtctggttggaaaagcctgtacaaaaacaggaaataaaccaggagttacaaaaggaaaacagtggatcaaattaaataagaatattgaattgttagatacccctggaattttatggcctaaatttgaagaccagcaggttgggcttcgtctggcattgatcggatcgatcagagatgaaatcctcaatcaggatgaaatggcgatcgaactgatcgagtatttaaaaaatcattatcagggaattcttgctgatcgctatcaagtagatgaaaatgaagataaagtgaaaatcttagaacagattgcgctaaatcgtaattgtaagatgaaaggaaatgaattagattacgaaaaagcatcaaagatcgtattagaggaattccgaaatgcgaaattaggaaaaatttccctggaaacaccagaagaagggacaaaagaggcataaaagcctttgaggggcagatataagaatgtttaaaagtattctaaggttgttgggtaccattttgatcgcggttgcatttgcatttgttcttattacgtgtgttggtgaacggacgaaagtaagtggacattcaatggaaccgcacttgcatgatcatgatcaagtgttgttagataagttaacatatcgttttcgggatcctaaacgatatgagatcattgtatttccaggaccagaaggtggcgatcagttttttgtaaagcgagtgatcgcacttccaggagaaacggtaaagatcacaaaaggaaaagtctatgtaaatgacaaagaagtaaaagattattctaaagatcatacgacagattcatgtgaattaaaaggaaagtttcatctttcatcagatgaatattttgttttaggagataacagagataatagtaatgacagcagatacaaagaggttggtccagtaaagaggtcaaagatcacagggaggatcattttccggttttatccatggaagaatgcaggtgtgatccggccataggaagggttttaagacttatgacaaagaaagaagaacgagaagccaggaagttagaaaaattaaggcttgagaaagaaagaatgtatgagatgttttcttttgaaagagaatatggagatcatcaggcgatttgtggaattgatgaagttggaagaggaccatttgcaggacctgttgttgcggctgcagtgattttgccaaaagactgtgatattttatatctgaatgattccaaaaagctttcagagaagaaaagggagcttttatatgatgagatttatgagaaagcagttgcaatcggtattggaatgtcttcagaagaagtgatcgatgagatcaatatcctgcaggcaacttataaggcaatgcagcaggcaatttcaaagctttcgataaaaccagatcttttattgaatgatgcggtaacaattccagacgttgagatcgaacaggttccgatcatcaaaggagatgcaaaaagcgcatcgatcgcagcggcaagtattgttgcgaaagttacaagggaccgtatgatgaaagaatatgatacaatttatccgggatatgactttgcaaaaaataaaggatatggaaccaaagcacatattgaaggaatcaaaaagcagggaatctgtgatatccatagaagaacatttgtaaagaaatacatataaaaaacaaaaaagtatatataatatgaagaaaaataacagggagacaggggcaaaagcagaagcgattgcctgttggtttctgaaacagcaaggatatgacgtccttgaacaaaacttttatacaaaagtcggagagattgatattatagcaaaagaagatcagacattggtatttgtggaagtaaaatacagaaaagatgacaaaaagggatatccggcacaagctgtagaccaaagaaaacagcagaagatccgaaagagtgcaatgatttatttaaagaagaatcatctatcttttgaacagccgatccgttttgatgtagtggagattttaggaaagaagatcagggtgataaaacatgcattttaaaaaatcaaacgataatcagtctacgatattacatgaggggtctgttccatatctgacatttaaaaaattggatcaggcaggagtcagacatggattttcaacacgtatgggtggagtcagcgaaggaatgttttccacgttgaatttaagctataaccgtggagataaaaaagaagctgtggatgaaaatttcagaagaatctcagaagcgatcggattcgatcatacaaagctggtattttcaaatcagattcatgagacgagaatccataaggtaacgaaagaagattgtggaaaagttatgaaagatatggatggtcttgctacaaatgagcaggggattccgctttatacaggatatgcagattgtgtgcctttgtttttttatgatccggtagaaaaggctgcagctttagcacattcaggatggagaggcactgttggaagaatcggtgccaagatggtacaatttttagaaaatgaatatggaagtaaaaaggaaaatatcatcgcagccattggaccatcaatctgccgaagttgctacgaggttagtgaagatgttgcagatgagtttaaaaaagaactgacaggacatgatgcaaaagaatttttggatgataaagggaatggaaaataccagcttgatctctggaaagcaaatgaaattattttgacagaagcaggaatccgtccagaaaatcttgatattacagatatctgcacatgttgtaatcctgatctactgttttcgcatagagcaagtcatgggaaacgtggtaatctggcagcatttattgtgttataaaaaggtaaataaaaagaatatatcttgtgaaattcttcacactggacgaatttcataagataaggtatactaagaaacagtacaggttttgaaacatttagagaggtatatagattatgagtaagccgatcattgccattgtaggaagaccgaatgtaggaaagtctacattgtttaatgcactggcaggagaaaaaatttcaattgttaaagatacaccaggagttacaagagaccgtatctatgcagatgtgacatggttaaactatcagtttacattgattgatacaggtggtattgaaccagacagtggtgatctattattaagccacatgagaggacaggcagagatcgcaatggagacagcagatgtgatcatcttccttacagacgtaagacaggggcttgtcgatgcagattatcaggtggcagatatgttaagacgatcaggaaaaccaattgtgttagcagtcaataaagtagataattacgaaaaattcgttctggatacttatgaattttacaatctggggcttggaacaccatttccagtttcagcgaattctaagattggattcggtgatctgttagatgaagttcttgttcactgcaatccacaggatgcagatgagaaagaagatgaaagaccaagagttgcaatcatcggaaagccaaatgcaggaaaatcttcattgatcaataaattattgggagaagaccgtctgatcgtttctgatattgcaggaacaacaagagatgcgattgatacaacggtcaaacgtaatggaaaagaatatgtattcatcgatacagccggacttcgaaagaaagccagagtcaaagaagatatcgaacgttacagtgtgatccgtacggttgcagcagtagaacgttgtgatgtggcaatcttagtcattgatgcggaagaaggaatcacagaacaggatgccaagatcgcaggaattgcccatgaacgtggaaaaggtatgatcattgcggttaacaaatgggatctcatcgagaagaacgataagacaatctacaagtttacaaaccaggttagagaagtgttatcttatatgtcatatgcagaacttgttttcatctctgctaagacaggacagaggcttcctaagatttttgatgttcttgatatggtgatcgagaatcatgcattacgtgtacagacaggagtcttaaacgagatccttacagaggcggtagcgatgaaacagccaccatcagacaaaggaaagagattaaaactttactatatcacacaggtttctgtaaaaccgccaacatttgttgtgtttatcaatgatcgtcagttaatgcatttttcatatacaagatatcttgagaaccagatccgtaatacatttggattcagaggaacaccaattcatattattgcgagggaaaggaaggaaagataatggcagtttgtattgttgtgtgtatgatcgtcggatacctgtttgggtgtattcagacaggatatattgttggacgagtaaataagatcgatatcagagattacggaagtggaaattccgggacaacgaatacattaagaactttgggaaagacagcagcgatcattacatttcttggagatgccgtcaaaggacttgtggcggtgaatcttgcgagatatgtgatcatgccggcttttcatgtagaaggagaagcttatctttggcttttgacaggatttgcagtagtactgggacataatttcccgttttatcttgggtttaaaggtggaaagggaatagcgacaactgggggagttatttttgcatttcactggcagcttgggttggtctgtgcagcagtatttttgatcattacggctatttctaagtatgtatcgttaggatcgatctgcatggtgctgatcattccatttattttgtattttaacaatccacatgattggaaattagttattgttggatgtatatttacagctatggcaatctggcgccatcgtgcgaatattgggcgtttgatgaatggtactgagaataaattaggtcagaaagtaaaacgttaggaggaacttaaacagatgaagaaagttagcgttatcggtgcaggaagctggggaagtgcccttgcggtattattagcaaataatggacatgaggtgacattgtggacacatgatccgcatgaaatagagatgctttccacaaagagagagcaggtagagaaattacctggagtaaaattgccagataatattatgatcgaggcagatcttaaaacagctttaacagatgaagatgttgttgttatggcagttccttcacctgttgttcgtatggttgcaaaacagatgtccccatttataaaagacgggcagatcattgttaacgttgcaaaaggtatcgaagatgttacatataagacattatcggatatcattgaagaagagattccaaatgcagaagtttgtgtactatcagggcctagtcatgcagaagaagtaggaagaggaattcctacaacggttgtagttggtgcaaagaataaagagacagcggaaatgcttcaggacgtatttatgaataaagtattccgtgtatacacaagttccgacattgttggaattgagcttggaggagcattaaagaacgttattgcattagcagcaggaacggttgatggtcttggatatggagataatacaaaagcagcattaatgacaagaggaattgcagaactgacacgtcttggagaagcacttggtggaaaaccagagacattttcaggccttacaggagttggagatctgatcgttacatgtacaagcgtacatagtcgaaatcgtaaagcaggatacttaatgggaaaaggtatgactgcagaggaagctatgaaagaagtaaaaatggttgtagaaggggtatattcagcgaaagcagcccttggacttgcaaggaaatgcaatgtagctgtaccaattgtggaagcagtgaacagagtgttatttgagaatgcggatccaaaagaagaagtttcaaacttactccttcgtgagagaaaacaagaacatacaaatcttgaatggaattaatcaggatatataaaaacataaatatatacaaaacataaaaacatgaaggaaggaagacaacaatggaatcatttagggaaatgtcaaaagaagagttacaggcacaggaagtggaagtgaacaaaaagtatcaggaatttaaagatcttcatctttcactaaacatggcaagaggaaaaccagcaccagatcagatcgatcatgcaaatggcatgcttgagacaatgacagattatcatgcaaaagatggtctggatgtgcgtaattacggagttcttgatggacttccagagatgaaagaaatattcagcgatttattagatattccagcaaagaatatcatcgttggtggaaatgcgagtctgaatctgatgtttgatcagatgatgagactggttgtatttggaacagcgggtgagaagccttggggacagttagagaaagtaaaattcttatgtccagcccctggatatgacagacatttttcagttacagaaactttaggatttgaactgatcacagtcgatatgacatctgaaggtccagatatggatcaggtagagaaactggttgcggaagatgaaagtatcaaaggaatctggtgtgtgccaaaatattccaatccacagggaatctgctatagtgatgaaacggttgatcgtttagcttctatgaagacagcagctaaagatttcagaatcttctgggataatgcatatggagtacatccaatctttgaagatgtaaaagttaagaatatcttagatgcatgtaaagaagcaggaaatgataacagagcatattatttcttctcaacatctaagatcacattcccaggtgcaggagtatctatcattgcatcaagcgatgataatattgcagagatcaagaaagtgatgacagcccagacgatcggatatgacaagatcaatcagcttcgccatgtgcagttctttaagaatgcagacggagtcagaaaacatatgcagatcttagcagattgtttaaaacctaaattcgagacagttcttaatacgttagagaaagagttaaaaggaagcggactgatcacatgggagaatccaaaaggtggatattttgtatctgtagacgtccttccaggatgtgcaaagagagttgtagaacttgccaaagaagcaggggttacattaactggagcaggagctacatatccatataagaatgatccaaaagacagcaatatcagactggcaccttcttacccaacagtagaagagttacagcaggcaatggatctgttttgtgtatgtgtaaagaaagcaggaattgaaaaactgttagaacaggcataagagttcataaaaaatactatgaggaatattctttatcaatggtgataaggcatgttcctcatttgtttttgtaatactagtatttggtttttaaaatataaattcaaagattgtatctatacaattaacacgttgatgtggtaaaataaaactgtttattcgtaaaataataaaaaggagttgattatacatgaaatttacaaagatgcacggttgtggcaatgactacgtatatgtaaactgtttagaagaaaagatcaataacccaaataaagtggcaaaatttatcagtgaccggcattttggaattggttctgatggaatgatctgtatctgtccatcagataaagctgattttagaatggccatgtataactctgatggttcagaaggagccatgtgcggaaatggtgtccgctgtattgcaaaatatgtctatgattatggactgacagataaaacaatgatcacgatcgagacaaaaggcggaattaaagaattagaccttacagttgaagacggcaaagtgacatgggtgaaagttgatatggaagcaccgatcacaaaagcttcacagattcctgcaatctatgatgatcttgatgaagtgatcgatcagccagtgatcgttgatggaaaagaatataatatcacatgtatttctatgggaaatccacatggagttgtatttgtagattctgttgcagatatcgacattgagaagatcggaccaaagtttgaaaatcatccaatgttcccagatcgtgtgaatacagaatttattgaacttgttgatgataaaacgatcaagatgcgagtatgggagagaggcgcaggagaaactcttgcatgcggtacaggagcctgtgcaagtgcttatgcatcttatctgaataagaaaacaggaaagaaagtcttggtacatcttttaggtggagatcttcagattgaatatgatgaagaaaaagatacgatctttatgacaggaccagcaacaacagtgtttgatggcgagatcgatcttacaggaattgacgattaagagtacaaagacagaagaattattggagatagaacatgatattaaaagaattattagaacgttcagaatataccctcgtgcaaggaagtgaagatgtagagatttctacattagtatatgattcaagaaagattgaaaaaggcagtgtatttgtatgtatcagcggagcagcctttgatggtcataaatttgtagcacaggctgctgaacttggagcggcagcagtcgtagtagaaaaagatgtagaagtaccagaaaatctgacagtgatcaagtttgataatacaagacttgctttagccgagatgtcagcagcatactttggatatccagcagaagagctgacaacgatcggtatcacaggaaccaaaggaaagacaacaacaacgtatatgatccgtgcagtcctagaacatgcaggacagaaaacaggattgatcggaacaatcgagacaatcatcggagatgagagaattccatccgtcaatacaacaccagaatcttatatcgtacaggaatctttccgtaagatggcggacgcaggattgaaaaatgttgttatggaagtatcttctcaggcattgatgcttcatagaacaagtggatttgaatttgattatggaatttttacaaaccttgcagaagaccatattggggaaaatgaacataaagatatggacgactatattcattgtaagagtctgttatttaagcagtgtaaacaaggaatcgtcaacggagatgatgactatgtagaaagaatcatcaaagatcatacatgtgcgatcgaaacatatggaatgaaggatacaaacgatgtttatgctgaaaatattacaagaattcaggaacctggataccttggagttgcttacgatctcaaaggaaaacaggaatataacgtacatgtagatatcccaggagactttacagtttataattccttggcagcaatctctctttgccgccatatgggaattgtcaaagaagatgtattatcagcattgaatacaattcaggtcaaaggacgtttggagatcatcaagactccaggagattacacattaatgatcgactatgcacataatgctatgagtcttgaaagtcttttaacaacgatccgtaaatataaccctaagaagatctactgcttatttggatgcggtggaaaccgtgcaaaagcaagacgttatgagatgggagaagtatcttcaaaacttgcagatcttaccgttgtaacatctgataatccaagaaatgaagaaccaatggatatcatcaacgatattttgatcggggttcacaaagcagatggagaatatgttacgatcccagatcgtaaagaggcgatcaaatattgtatggaacatgctggagcaggagatattgttattcttgccggaaaagggcatgaagactatcaggagatcaaaggtgtgaaacatcatatggatgagagagatctgatccaggaaattatcgaaggaagatagagcatctgtcttttgaaatatataaagaaacgaaggagaattacaaacgtggaagcaagaatttcaggaacaacaaaattattcggattgattggttcaccggtttcacattccgcatcaccagcaatgcagaattacggttttcaggcatgtggagtcgatggagcgtatcttgcctttgatattaaagaagaggaagtgccagaattcgtaaaatccatgcgtctgttaaatattcagggatgtaatgttacaatgccaaataaaacagcagcagctcagaatatggatgaattatcaccagcagcagaattgatcggtgccgttaacacaattgtaaacagagacggaaaattatacggacatatcacagatggtgaaggttttgttgcaaacttaaaagatcatggaatcggcgttgaaggaaaagatatcgtaatctttggagcaggtggagcagcaacagcgattcaggtacagtgtgcattagatggcgcaaaatctatcacgatctttaacccaagagatccatttttcgagagagcccagaagatggtagagaagatcaaagctaaggtaccagaatgtcaggtagaattatatgatctcgatgcgaaagatacaatgcgtgaaaagattgatgcagcagatattttagttaatggaacattacttggaatgaaaccaaaagaagatacaacagtgatctcagatacaacaatgtttcatgaaggattagttgtagctgatgttgtatataatccagaagagacaaaattcttaagagaagcaaaagaacatggatgtatcacagttccaggaaaaggaatgctattatggcagggagttgcatctttcaaattatttacagggaaagatatgccagttgatgaagtgaaagaaagattcttccagggagtataagatacatagatcatatatggaaacaaaaagatcagaaactgtaataagcagatttctggtctttttttcttattgttttcatatactttatcagtctataaaggaggaacttatggatcagtttaatgtatataaggatatgaaagcaaggacaaacggagagatttacattggtgttgttggtccggtgcgaacaggaaagagtacatttatcaaacgttttatgaatctaatggtattgccaaatatcgaagatgaaaacgacagaaatcgtgcaaatgacgaacttccacaatcttcaagtggtaaaacgatcatgacaacagaaccgaaatttgttccaaatgaagcagtatcaataaagacggaagaaggaatcgaattaaatgtccgactgatcgattgtgtgggatatatggtggaaggcgctacaggacacatggaaggagaagaagagaggcttgtaaaaacaccttggtttgattatgaaataccatttacgaaagcagcggcaattggaacaaagaaagtgatcacggaacattcaacgatcggtgtagttgtaacttgtgatggttcttttggggaaattgcagcaaaacaatatgagccagcggaagaagaaacgatcaaacaactgaaagcattgaaaaagccatttgttgttttattaaatacgattcatccatattcagaaagcacaaagcagctagcggctgaaaaggaagaaaaatatcagacaaaagtgctaccaatgaatttagaacagatgaaaaaagaggatatttatgaaattataaagagtgtgttgatggaatttccgatttcatcaattggattttatgttccaagatggacggagatgttaaagaaagatcatccattaaaaatggaattacttcaaatggccagagatgtgatcacagaaaaaacaacaatgagagacatttatgaagaacaagaaaaagaatatgagtacataacggggcagaaactagaatctgttgcgatggacagtggggaagtggtcatcacagtaaaagttggggatgtatattattatgaatttttaagtgaaacaacagggatggagattcgcaatgaatatgaatttatcaagatcatgggagaattagcaaagaaaaagaaagagtacgaagaagttggagaagcattggcggcagtaaaacaaagaggatatggtgttgtgacaccgacgaaagaagaaattgtattagaagaaccgcagattgtaaaacatggaagtaaatacggagtaaaaattaaggcaagtgcaccttctattcacatgatccgtgcaaatatttcaacggagatcgctccgatcgttggggaagaatatcaggcaaaagatctgatggactatattgagcagggatcgaatcagccaggggaaagtatgtgggatgtcaatatttttggaaagacgttagaacagctggttggagacggtatgcagacgaaggcattaaaaatgacagatgagagtcagcaaaagcttcaggatacaatggaaaagatcataaatgaaagtaatggcggtcttgtctgtatcattatctaagaacaattgacaaacggatggaaaaagaatatactttgatagacaaagtgtttttgatctgtcatttatgagtacagatcaagaagagaaaaaaagaagcgattaagataagtggagtagttatgtctgtaaaaatattaggaacaggaagttttcttccagaaaaatcagtgagcaacgatgacctttccaaagtgatggatacaagtgatgaatggatttcatccaggacagggattcgcagcaggcacatttcgattgaagatacaacatcaacgatggcagtgaaagctgcagagaaagcattagaagatgcaggaatcagtgcggaagaattagatcatattttcgttgcaacattatcaggagattatgcaacaccaagtacggcttgtcaggtacagaaaggaatcggagctgtcaatgcagtctgtatggatattaatgcagcatgttcaggattcgtttttggattaaatacagcagttgcatatgcgagagcaggaatgggtaagaagatgatgatcattggggttgagacactttctaagattcttgactggagtgaccgcagtacttgtgtattatttggagatggtgcaggatgcgcgatcgtggaagcggatgaagaaagagaaatctttatcgatgcaggatctgatggagcacgaggagatgttttaacatgtgaagaaagacatttaaacaatctcttagtaaaggatgattctccaatgcaacaggttgccatggatgggcaggaagtattcaaatttgcagcacgtatggtaccaaagagtattaacaaagttcttgatgaagcaggcgtttccaaagaagaaatcaaatattttgtattacatcaggctaacaaaaggatcattgaagcagcagcgagaagattgaagcagccaattgaaaagttcccgatgaatatagaccgttgtgcgaatacttcatcagcaacgattccgattcttttagatgagatcaatcaaaaaggaatgctaaaccgaggagataagattgttttaagtggttttggcggaggacttacttggggttctgtttatcttacatggtaagaagcaaacaaatacgatacaaatgaagataaaaatagtcagctttcatataagatgataggagttgactatttttttattgcataggaaatttcaatgaaataaaaaatatgaagtaagaagaaagaatcctgtaatacaagattctttttgaagttaaaatatgatataatgagtggataagtacaggagggaattcatggaattacagttatggagagaaatgctcaccccatatgagctggcagttgatgaacttgtgttaaagtttcgacatattataagagaatacagaaatgtcggaagatattcaccgatcgagcaagtcgatggacgtgtaaaatctatctcaagtattttggataagatgcagagaaagaagatcaatgtcaatgatgtagaaaaagaactggaagatattgcgggaatacgtttgatctgtcagtttgtggaagacattgatcgtgtattagagatcatagagagtcgttctgatatggagatcaagagccacaaagactatatttcacattccaaagacagcggatatcgaagctatcatgtgatcatctattatgaagtgaatacgatttatgggaagaaacggatacaggcagagatacagatccgtacacttgcgatgaatttctgggcaaccgtggaacattctttacagtataagtataaaggggatattccacagcatgtgacagataaattattagttgcatcagatgcgatcgatgtcttagaccatgagatgtcaacagttcgtgatgagatcatggatgcacaggattcattccgtaagaagtcaaatcttgtatctgagatccttcatacgatgcagaatttatataaagttgcgaatcgtcatgaagtattaaagattcaggatgaattttataaaatatatgagacaggagatatggaacgcttagagcattttaataaacagttggatattattgcagaaggatatcgtgctcagagcatttcttaagaagaatatgaaattaccagaattatttgaagagaagatgagacgtctattgggcgaggatttttcggaatatgagaagcatttagatgatcctgcatattatgggatcagagtcaatacactaaagatctcagtggaagactttttgaagatctgtccgtttcatgtgacgaaagtgccttggacagataatggattttatgtagacagggaagaaaaaccatcaaaacatccatattatcatgctggattatattatatacaggaaccaagtgcgatgacaccagcttcctacctgcccgtagaaccgggagaccgtgtgcttgatctgtgtggggcaccaggtggaaagtctacagaacttggagcaaagttaatgggagaaggattactggtatcgaatgatgtcagtatctcaagaacgaaagctctgatccgtaatatcgagatgtttggcatccgtaatgatatgatcctttgtacggaagccaaatatttagtaccatcaatgacaggattttttaataagattctaattgatgctccatgttctggagaaggaatgtttcgaaaggggaataatgagatcaagaactggcagcagaaaggaagcgaaccttatgcaaaattacagcgagagatcgttgatgatgcgatcaagctattagcgccaggtggtatgctactttattctacctgcacattttcacccgaagaaaatgaacaggtgatcgaatatctcttagagaagaatgaagatctttctcttgtgccaatgaagatgtgtgaaggatttgacaacggacacccagaatggactttgacaggaagagaagacatcaaacaatgcattcgattatggccgcataagatcaaaggagaaggacattttcttgccttattgaagaaagcagacggagaacagccaacattcaaatacgaaaagattaagaaagtaaaactgacaccagagacagaagaattcttcaaaaactgtaagatggatattgactggagtcatgttagagaacatcaaggaaaattgttttacctaaaagaagatattccagagatgaagaaggtaagagttctaaggaaaggtctttatctaggagagatgaaaaaaggaagattcgaaccgagtcagtcatttgcagtagcgttggcggccaatgagtatgaaccatatctttcgtttgacatcaacgatgagaatacggtcaaatatttaaaatgtgagacattagacgtagatacaaataccgaaggaattcatctggttggaacaaatgaatttccattaggatgggcgaagattaaaaaaggacgactgaagaataagtattcttccagctggagatggttataatggcaaagaaaaccagattagacaaatttttgtgtgacagtttaaatatgacaagaaaagaagcgaaagagtctgtcaaaaagggtaaagttgtggttaatggagaagcgatcaagaaaccagaatataaggtggatgcagaacaagatcaggtagaatttgaccacaaactgattcagtttgaacagttccattatctgatgttacataaaccacaaggggttgtatctgcaacgaaggatcatcatgatcagactgtactcgatctgatccatgaagattataaagacagattgttccccgtaggaagattggataaagatacagaaggattattattattaacggatgatggaatgctggcacatgaacttctttcgccaagaaaacatgtggataaagtatattttgcaaaagtttcagggcagtttggcgaaaatgagatcgccagattcaaagaaggtctggatattggcaatggcgaaagatcaaaacaagcaagacttcagatccttaaagcagatgtacaagaatcagaggttctgatcacgatcatggaagggaaatttcatcaggtaaaacggatggtaaaagctgttggaagtgaagtgttatatttaaaaaggctgtcaatgggatcattaaaattagatgaagagttaaagcttggagaataccgaagattaacgaaggcagagttacaagaactaaaggagcataggagataaatgttagagaataaaaaagcagtaatctttgatcttgatgggacattagttgattccatgtggatctggagagagattgatatccgctttttgggaaaatatggattggaagttccgcaagggttaaatgataaattagaaggatatagttttcatgaaacagcagtttattttaaggaacattttccgttgccacttacgatcgaagagatcatgggaacatggaatcgtatggcttccgaaatctatatcaatgaaattcgtttaaaagagggcgtgaaagaatttattgagttgttaaaaaaacagaatatgaaacttggaatcgcaacaagcaattcaagaaagctggcgaaagattgtttaagatccaatgggattttggatgcatttgattatatctgcacgtccgatgaagttccaagaagtaagccggaaccggatgtttatttgcatgcagcaaagatgatcgataccagaccaaaggatgcattggtctttgaagatattccatatgggattttggcagggaaacgtgcaggaatggaagtgtgtgcagtgaaagatccatattctcaaggatcagtgaaagaaaagaaagaaattgcagattattatattaatacatattatgacatactagatggaacctatgaggtattaaagaaataacagatgccaggagaaaggatgatcatatgagaaatatcgcattggtaaccggagcatcttccggaatgggaaaagaatttgtccgtgagatctcgaagaaatataaggggctcgatgaaatctgggtcgttgccagacgaagagagcggctaagagaactaaaaaaagaaatcattggaacaagagtgaggattcttccattagatcttatgaaggaagaaagctttgaacgtcttaaaatggttcttgcaaaagaacagccagttgtaagaattttagtgaatgcttctggatatgggatttcggggccttttgaacatcagacagaggaagatgcggcaggaatgatccatttaaactgtgaagcattaacaagaattacatatcttgtattgccatatttaagaagaggatcttttatttatcagatggcatcttctgcgggatttgctccgcagccgaatttcacagtttatgcagcaaccaaagcatatgtgaaaagtttctctattgcattgcggcaggagctgtcctatcaagggatcagggtgatcgcagtatgtccagggccagtaaaaacggagttttttgaccgtgcatatgaacaggaagaggtgaaattttataagaaattcgtaatggcagctccaaagaaagttgtaagaaaagcaatccgtgatgcgagaaaaaataaagcagtatctgtttatggaatgacgatgaaagtaactagggttatctgcaagcttcttcctggaagatggatcgcaaaaatcatgggtaaataaggatataaaatgagagaattaaacataacgacaagagaagaaggacagagattagataagattctttcgaaatatttaaataaagctccaaagagttttgtatacaagatgcttcgaaagaaaaatatcaagttaaacggcaaaaaagcaacgggaaatgagaaattatctcagggagatcaggtgtgtatttatcttgcagaagatacgatcaacaagttccgtgaagaagttaaagcaggaaagcaaaagatcaaacttgatgttttatatgaagatgagaatgtcattatggtcaataaaccatggggaattttatcacagaaatcaaaaccagaggatatttccatcaatgaccagatcatcccatatgcagtgaaccaagggttgatcagtgaaaaggaattgcaggtagtaaaaccatcgatttgtaaccgattggaccgcaatacaacaggaatcatcatttgtgggatttctatagaaggattacagacgatggcagaaatgctaaaacatcgtgatatggaaaaatactatctttgcatcgtaaaaggaaaacttgaaagaacacaaaaagtcagtgcttatttaaagaaagatgaaaaaacaaacaaggtaaagatatcaaaacaggagatcgcaggagcaagccatattgagacagcttatgagccagtgatatcaaatgatgaatttacactattgaaagtcgaactgatcacaggaaagacccatcagatccgagcgcatcttgcaagtattggacatccgttgatcggagattttaaatatggcgataaaaagatcaatcaggagatgaaacagagatttggattaaaagatcagctgcttcattgtacagagattgtttttccacgagatatgaaaacgtgcaaaaatttatccggaaagaaaattcaggcaccacttccgaagcgatttgatatgatcaaaaacgacttgtttgggagagcatagtcatggcagaagataaatggaatgtaaagggacttcgaggatcggtccttgaagagttgatcaactatacgaatgaaaaatacaggcaacagaaacttgctcttgtacagaaaataccgacatcgatcaagccagtcagatttgataagacaaaacgtcatattacgcttgcttattttgatcagaagagtactgttgattatattggggttgtgcagggaattcctatttgttttgatgcaaaagaatgtgcaaaagacatatttccacttcagaatattcatgaacatcaggtagagtttatgagacaatatgaagaacagggtggaatcagttttttgttgatctattttacatcaaggcatgtttgctattatatgtcatttcaggagatgatgaagtactggaatcgtgcaaaagaaggcggagtgaaacatttcaaatatgaagaattagatattggtttttttgttccactaaagcagggaatgatccttcattatctggaatgtctgcaaaaagtattagagcaaaaagatcaataagattcgtgtcgaaaacattgacgagaagcgaaattttgcgtataatataacattgacgaaaaagaaaagctgtggattttaaagcgcagcgcagaaaaggatagattttatgatcagaagcatgacaggatttggacatggggaagtgtccaatgacaagaatcagaaggtcacagtggagatgaaatccgtcaaccacagatattgtgacatctcattaaaacttcccaagaaattagccatgtttgaggcaaatatccgtaatatcatgaaagaatacgcaagccgtggaaagattgatatttatgtgtcttatgaagatttgtcagagacagcggtaagtctccattataatcaggcaatggcagaagaatatatgcaggtatttaaaaagatgcaggaagattttaacattgaaaccaagatcactgcagaagccctcgccaaatatccagaggttgtaacaattgaggaagtacagcaagatgaagaagtatggtgggagttgctagaagctgcattaagacaggctgcggagaagtttgtagagacaagaacgattgaaggagcaaaccttaagagagatcttttaggcaaacttgatcagatggcagcagatgtggcgtttattgaggaacgttctccacagatcattgcggaatacagaagcaaattagaagaaaaagtgaaagaatttttagaagactcaacgatcgaagaaaacaggatcgcagcagaggttacattgtatgcagataagatcgctgttgatgaggaaatcgtaagattgcaaagtcatatcagctctatgacagatgtgttggaaagcgatgaaagcatcggaagaaaacttgatttcatggcacaggagatgaacagagaagcgaatacgatcttatccaaatcaagtgatgtcgatcttgcggatcatgcaatcgaactgaagacaaatgttgagaaagtaagagagcagattcagaacatagagtaagataagaagggaaagatcatggaaaagagaggttcattactggtaatctccggattttctggagttggaaaaggaacggtggcaaagaaactggtagaaaaatatggatatagtttatcaatttctgcaacaacaagacaaccaagagaaggtgaagttgatggcagagagtattttttcaagaccgtggatgattttaaaaatctgatcgattataatggatttattgaatatgccagatatgtggacaattattatggaacgccaagaaagtttgtggaagatgaacttgccgcaggacataatgtaatcttagagattgaggtgcagggtgcatttaatattaagaagcaatatgaggatgcattgttgatctttattacagcaccaagtgcagctgcgatcaaagaacgcttagtaggcagaggcacagaatctgaggaagtgatcaataaacgtttaaatcgcgccaaagaagagtcagaagacatggataaatatgattatatcgtgatcaatgatcaggtagaagactgcgcggatcgaattcatgccattgtgcaggcaaaagaatgcctgcttggaaataatcttaagtttatagaagcaacaaaaaaagaattagaacagctataggaggaattattatgttacatccatcatatacagaattaatgaaggtcatcaatggtgacagtgaagaagagaaagttatctcaagccgttattctatcgtgcttgcaagtgcaaagagagcaagacagatcatcgcaggagatatgccattagtagaagaaaaagatggtgcaaaaccattatctacagctgttgaagaactttgggaagaaaaagttaagattctcggagatgacgaagaagcagaagaatagaaacagtaaggaaaacagggtgcttagggattcctaaacacccttatttgtacagatagggagttttttatggacattattttgttacttaaaaccgtattacttggaattgttgaggggattacggaatggttaccgatcagtagtacaggacatttgatcttagcagatgaatttatcaagctgaacatgacagctgactttaaggagatgtttgatgttgtgatccagttaggtgcgatcatggcagtcgttgtcttatatttccataagttgaatccattttcaccgaagaagaatcacgacgagaagatggatacgatcattttatggacaaaggtaattcttgcagtatttccagcagcaattattggtattttgtttgatgactggttgaacgatcatttttataatccaccagttgtagcagcaatgctgattatctatggtgttttatttatcattattgaaaaccgcaacaaacgaagcagaagaagaccaatgaatgatctttccagattatcctatggaatggcacttggaatcggtgtatttcagatattggcattaattccaggtacatctagatctggtgcgacgattcttggaggaatcttgcttggatgttctagaacagtagctgctgaattttcatttttcttagggattcctgtgatgtttggagcaagcttattaaagatcgtgaagttcggtcttgcatttacatcaacacagttgatcgtactgatcgtaggaatggttgtatcatttcttgtatcaatcggagcgatcaaattcttgcttggatatattaagaagaatgactttaaggcatttggtgtataccgaatcatactcggtctgttagtgatcgtgtattttgcattcatcaaataaggagtttgtaaaacatggataagaatttatttctaaagaatatggaagagatgatccagatcgcaaagacgaatggtaatcagatcgaccacaaagaattattagattattttagcgattatgaattaaatgaagaagcgaaaaaacttctgatcgcaagttttgtagaagctgggattcgcgttctgggtgttgatgaagcacagatcgttgcagaagaagaggcgaaagaaaaagctgacatttcggaagaagaacagggtgcgatccgattctatgaagaagaattagaacagatggatcttccgggagaagaagagcaaaaagaactgatccatgcatggcttgtagagaaaggagatggagaagcagtcattgaaagctttcttccacagattcttgaaattgcaagaacacatacggggaaaggtgttttattcggagatctcgtacaggaaggtaatattggccttttggaagcaatggcaatttatcagggaaaagacgcagaaggattccttgcacatgcgaagagtgcagtagaagattctattttagatgcgatcgcaatacaaagaggttctgacagtgttggagaggcgatggcgatcaaggcaaatcgtctggatgatgcttccactttcttatcaaaagagcttggaagagaaccaaagattgaagaactggcaaaatatctgtccatgacagaagaggaagtcaaagaggttatgaagatatccctagatgctctttcagtgatggaagctgatattaaacagtcatagaagaaacaaatatcatatggaacgctttgtggaagcagatgggagggctgatcttatgaatatccgagaaaaacaagaacagacagagatggaattattaagtccgtatgcgacacaaagcatccgtacaaaaggaagaaaaaagcctgaggtggaatgtgagataagaacctgtttccaaagggatcgggatcggatcgtccattgcaaggcttttcgccgtttaaaagataagacacaggtatttttatctccagtgggcgaccattatcgaacaaggttaatgcacactttggaagtatcgcagaatgccagaacgatcgcaagagcattagatctcaatgagacattgacagaagcgatcgcgcttggacatgaccttgggcatacaccgtttggacatgcgggagaacgagtgttaaatgagatgaatccagcaggatttaagcataatgaacaaagtgtcagggtcgctcagtgtctggagaagaatggacagggattaaatcttacatgggaagtcttagatggaatgaaaaatcattcaatgcacagcatgccgcatacattagaaggaaaaattgtgcgactggcagacaaaattgcatatatcaaccatgatattgacgattccgtacgagctaaggttctaagggaagaagatcttccaaaagaatttacggaagtccttggaacaacatatcgggaacggatcaatacgatggtgcttgatattgtaaaacatagtgagaatctgaatgatattgtgatgtcaaaggaagtaagagatgcaatgatcggtcttcgaaagtttatgtttgagagagtttatgaagaaccaaatacgaagaaagaagaagacaagatcaagaatatcattggtccgttatatgagtattatctgatacatgttgagcaattgccagaatataataagaagatgatcgataaaccaggagatgtacctgtggcagtttgtgactatattgctggaatgacagaccattttgcaattgagaaatatactgagatttttatccccaaattttttatgcaaaaataaaggaaaataaaaaaaggtgtagaataataatatatagagggattttttaaggagggacaagcgttgatttatggtgaagaaatcatagaagaggtgcgaagccggaacgatattgttgatctgatttcgacgtatgtaccgttgaagaaaaaaggcagttcttatttcggtttgtgcccgtttcataatgaaaaatcaccctctttttctgtgagccgagataaacagatgtattactgctttggctgcggagccggaggtaatgtttttacatttttaatggaatatgagaatttttctttcccggaggcattaaaatatctggcagagagagctggaatggaacttccggaagaggaattgaatgaagaagccaaacgagcgatggatgaaaaagccaggcttcgggagatgaataaactttcagccaattatttctattatctgcttcacagcaagcggggacagaaagggcttgcatatttaaaagaccgtgggatcacagatgctacgatcaaacattttggtcttggatatgctgatatttataatgatgacctgtatcgatttttaaagagtaagggatacagtgatgaagatctgaaagattcagctttggtgacgatcgatgaaagacgtggtggaagtgataagttctggaacagagtgatgtttccaatcatggatgtgaacaaccgcgtgatcggctttggaggcagagtcatgggagatggttcgcccaaatatttaaattcaaaagaaaccaaattatttgataaaagccgtaatctttacggactgaattttgcaagaagttcaagaaagaaagagattatcttgtgtgaaggatatatggatgttatttccatgcatcaagcaggatttacaaatgcagtcgcagcacttggaactgcatttacaagtggtcatgggacgctgcttaagagatatacagagaatgtcattttgtcatttgacagtgatgaggcgggacagcgagcgatattgcgagcgataccgatcttgaaagaagcaggacttacggttcgtgtccttgatctgactccgtataaggatcccgatgaatttatcaaaggattaggagcacaagcactggaagaacgaatcagaaaagcaatgagcagttttatgtttcaggtaaaagtagccgcaggaagatatgatcaggacgatccagagtcgaagacacagtttcaacatgaagcggccaaactgctggcaacgattgaagaaccgctagaacgcaagaattatattgaagctgtttcaagagaatattatatcggggcaaaagatctggaagatcttgtgaattattatgggacttctggatacagcagtgctcagagacagcagacaacaccgcgtcagcaggagagacgtctgcaagtgaatgaggcaaaagaagagaagaagaaacagccgcagaaactgttattgacatggatggtcaatgagccacagttatttgacaaactagaaggaatcatcggccccgatgatttttatgaacagatttaccatggagtggcattgttactcttcaaacaatacgaagaagagaaagcagtgattccagggaaaatattaaatcaatatacagatcttgaagaccagaagaagattgcagaattattcaacacaacattaaagatcagtccattagcggaagatcgagacaaggcgttgaatgatatcgtgcgaagggtcaaggaagacagtattgaacaacagatgaacgcaacaaatgatattttgagatggcaggatctcatcaaggagaaagcaaaccttgcgaaactgcatatttcattataggttggttaaaataggaagagaagaaagggacgaattatggaaggtacaatggaacagttcaccgagaaacttgcaggtctggtggaattaggaaaaaagaataaaaactttttggagtatgcacagattgattcatattttaaggatatgaaactaaattctgatatgatggaagcaatctatgattatctggaacaaaatggaatcgatgtgctgactcttgccgcagttgcagacgatgatgaagatcttgatgatccaatcgaagatgaaacagaaattgctgttcctgatggtgtcagcatcgaagatccagtccgtatgtatttaaaagagattggtaaagtacctcttcttagtgcagatgaagagatcaaacttgcacagagaatggaagaaggggatgaagcagcgaagaagaaactggcagaagccaaccttcgtctggtagtcagcatcgcaaaacgttatgttggacgtggaatgctcttccttgacctgatccaggaaggaaatttaggtcttattaaagccgtagagaaattcgactatcgcaaaggatataaattcagtacttatgcgacatggtggatccgtcaggcaatcacaagagcgattgctgatcaggcaagaaccatccgtattccagtgcatatggtagaaacgatcaacaaactgatccgtgtatccagacagcttcttcaggaacttggaagagaaccttctccagaagaaatcgcagaggagatggatattccagtggaaagagttcgtgagatcttaaagatctctcaggaaccagtatcattagagacaccaatcggtgaagaagaagacagccatcttggagacttcattcaggatgagaatgtaccagtaccagcggatgcagcagcatttacgctgttaaaagaacagttagatgaagtacttggaacactgacagagagagaacagaaagtcttaagattacgttttggattggatgacagcagagcaagaactctggaagaagttggaaaagaatttaacgttacaagagaacgtatccgtcagatcgaagcaaaagcactgcgtaagttaagacatccaagccgcagcagaaagttaaaagattatttagattaaggtatgattatggaattatcaaacagattagaaacaatcgcatcttttgtcacagaaggttatgtagtggcagatatcgggacagatcacggatacataccaatctatttaacaagtaatggaaactgcccgagagcttatgcgatggatgtaaataaagaaccattaagccgtgccaaaacacatattgaagaagagaatgcaggagaggttgtatcctgcattctttccgatggattacatgaactgccgcaagatgatgtagattctattgtaatcgcaggaatgggtggagatctggttgtcagaatcttagagcaggactttgataaattagcgaatgtaaaagaattgatcttatccccacagtctcatttagaacgagtgagacatttcttaaataatcatggattccggattttagaagaagaattcttaaaagaagatggaaaatactacgttgtgatccgtgcagttcatggaaagcaacagtatgacaaagagtgtttttatcgttttggagaagaactgatcctcgcaaaacatccagtacttcttgagtacttagatcaggaatatgtcaaatattcaaaaatcaaagaaagtcttacagacgattcaaaagaacacatcagaagacgaaaagaagaagtggaagatttacttggagatatcatggaggcactttgttattatgaattgtagagaactgatcacatttttagaaacagaagttccgttagagacagcagaaggctgggataatccgggatttcttgttggagataaagataaagagataaagaaagttttagttgtattagatatcacaaatgaagttgtagattatgcgattgatcaaaaggcagattttatccttgcacatcatccgatcattttttcaaagatcaacaaatgcacgagtgatgatttccttcagaagaaattattaaaactgatccgccacgatatatgtgcatatggaatgcatacatgttacgatgtctgcagaatgggagatcaagtagcagatcgcttgaatttgaaggaaatacagggaccagttgagctatctaaaagccacaatgagaaagcgtttggaaaaggaatagggattgttgccaagattgaagatgagatcagtgttggagaatacgcaaagaaagtaaaagaagcattttctttggaaaatgtcatggtatttggcaatctagatacaaagatctctaaacttgcagttgttccaggatcagggagaagtatgatcagtgaagcgaaaagtacaggagcagatgtatttttaactggagatatcgggcatcatgaaggccttgatgcagtcgatatgggaatgtgtgtgatcgatgcaggacattatggattagaacaggtatttattgatgatatgaaagatctgatcaggactcatttcagtgatatgaatgtgatcacatataaggcaggaagcccttataaagttgtttaaatagtagttatataaaaaggaagtgatggcgtatgatcaaagccacagtgaatcaaagcatttatgaagtaaaagaaggaacaacactttctgatcttgcgaagcaggtacagaagcctcaggagccgatcattttgcttgcctatatggatggaaagttaaaagaattatttactcctatgacaaaagactgtcatgtgcgttttgtgacattaaaagaacaggcagggtatatggcatataaacggactgccacgcttatgtttttgaaagcatgcgaagatctgcttggaactggtgcaacgacaaagatcgcattagattattcaatcggaaatagtattttttgtgatttcctagaagatcgtgtgatagatgaggcttttgcacgatctattcaaaagcgtatggaagagctagccaaagcgaatcttccgatcacaaaaagatcgctggacacagatcaggctgcaaaatattttgataggataggctttaagggaaagaaagaattatttcagttccgcagggaatcaaagacgaatatctactcgttagatggatatgataattatttttatggatatatggcaccatcgacaggatatattccagcatttttggtgtctgcatatcagcatggggtagtacttcagattccaaaaaggaaacagacggaggaaatcgtaccatttacaccacagccaaaacttttccatgtgatgcagcgttccagagaatggacgaagacgatgggtgttgacacagtaggtgccctaaataatgagatcacacatggaaatatcaatcatttgatcttattacaagaaggattgcaggaaaaacttcttgcagatattgcggatgagatcgtaagcaagaacaagagaatcatcctgatcgcaggaccatcatcctcagggaagacaacattttcccatagattatccattcaattgcagattgctggattaacaccacacccagtttctatggatgattatttcttagacagggaattgtctccaagagatgaaaatggaaattataatttcgagacgatcgcatcattggatgtggatcttttaacgaaacatatcaatcagttgctagatggggaagagattgatgtgccaagttataactttatcacgggaaaaagagaatatcacggacacaaattaaagattggagaaaaagatgtcctggtcatggaaggaatccatggattaaatggtactcttacgaatgaaataccagaagatgcaaaatatagaatctatgtcagtgcattaaaccagatcaacttggatgaacataatagaataccaagttcggatggaagattgttgcgaaggatcgtgcgagatgccatgacaagaggaaatgatgcgagagagacgatctccagatgggattccgtaagaaagggagaagaagacaatatttttccatatcaggaagaagcggatgtgatgtttaattcggcacagatctacgagatcgcagtcttaaaacaatatgcggaacctttgttgtttgcggttccaagagattgtcctgaatatcaggaagcaaaaagattattaaaattcttagaatatttcttaaatattccaagcgaagcaattccaaaaacatctcttttaagagaatttatcggtggtagttgctttgaagtgtaagatatgatataataattggcgcttagtcggacaaatggtcgcgccgtttcaaacgaaagggaaacggtgaggaaagtccgggcttcacagggcaggatgccggataacgtccggtaggggcaaccctcaagctagtgcaacagaaatataccgccacattcgtggtaagggtgaaatggtaaggtaagagcttaccgcctggctggtaacaggcagggcatatgtaaacctcatccgaagcaagaccgagatgaaaacgatagatcggcccgatctgttttcaggtgggtcgctggagcttgctggtaacagtaagtcgagatagatgaccattcaacgacataacccggcttatcgtctggctaagcattatgaataagaatgatagagaagttgtaagagaaatcataagtagatcttacaacttctttttttgatatgtaaaaagaagttataacaaatgtatttctttcagaaacctgaaaaatcttgaaagaaattgcagatatatatataaaaatgacgataaattggacaaatcaaactattcgtgaaagaactttcaaaatatcaaaaaaacttgaaattaattttaaaacagatatactaaagataacgaaagcaggaaagggaggaattgaaaatgaatccgaaagttgagaatttaaaaggaaaactgatcgtatcctgccaggcattgccagatgaaccattacattcttctttcatcatgggaagaatggcacttgctgcaaaacagggtggagcatcgggaatccgcgcaaatacaccagaggatatcaaagagatcaaaacacaggtagatcttccagtgatcggaatcatcaagagaaattacgatgactgtgagatttatattacaccaacgattaaagagattgacgaattaatggaagcgaaaccagagatcatagcattagatgcaacaatttcaagccgaccaaagggacagaaattagatgagttcttccatgagatcaaagaaaaatatccagatcaactactaatggcagattgttctacaatcgaagaagcacttcatgcagatgaattaggatttgattttatcggaacaacaatggttggatatacaaaacaaagcagcaaccttaagattgatgaaaatgattttgaaatcttaagaacgatcctttccaaagtaaaacatccagtgatcgcagaaggaaatatcaatacaccagagaaattaaagagagtcttagaattaggagcgttttgtgcagttgtaggttcagcgatcacaagaccacagctcatcacaaaatcatttgcaaatgccatcaaataaaagcatttttaaaaggatcatgtatggattattatgtaaaatcggtcataccgatcattgaatcaaattatgaaaattttacagctctggaaaaaaatattgcggatttctttatgaaaaatgaagaaaaaatggacttttcagcaaaagagatcgcaaaacacttgtttgtttcagaagcttcgttatcaagatttgcaaaaaaatgtggatttcgaggctatcgagaatttatttatcaatatgaggaatcatttgaagagaaaaataaagaactcacgggacatacaagaaccgtgttaaatatgtaccaggagttgttaaataagacatacagcctgatggacgaagcacagatcataaggatctgtgagaaattaggacaggcaaagagagtgttcgtatgtgggaaaggaagttccggccttgcagcaagagagatgcgcctaagatttatgagaattggagtagatatcaattcgattcaagatccagatctgatgaggatgcaggcagtattccaaaaggaaggttgtcttgtgatcgggatcagtatcagtggagagagtgaagatgtttgttatctattagaagaatcaaaaaaacgaggagcggacaccattttgatcacaggaaaaaataaggatgactatgaggatatctgtgacgaattagttttgatcgcatcaagaaaatatttagatcatggaaatgttatctctccacagtttccaatccttattatgttagatcttatatattcttactatttagaacacgataaaaagaaaaaagaaaccatgcacgatgacactgtgcgcgcattaaaaggagaaaaatcatgagaatcatcaaaacaaaatcatacgaagaaatgagcagaaaagcagcaaacatcattgcatctgtagtcacattaaagccagactgcatgttaggacttgcaacaggatcatcaccaatcggaacatatgatgaattagtaaagaaatatgaagcaggagatcttgatttctcagaagttacaacagtaaacttagacgagtacaaaggattaccaaaagaaaatgaacagagctattactatttcatgcatgaatacttattcgataaagtaaatatcaatccagaaaaaacatatcttccagatggaacaaacttaaatagtgaagaggaagcagcacgttatgaagcattggtacagtctttaggaacggttgatcttcagttattaggattaggaagaaacggacatattggattcaacgagccaggggatcattttgaagatggaacacactgcgtagagttaaaagaaagcacgatcgaagcaaacaaacgattcttcgaatcagcagatgatgtaccaaaacaggcatacagcatgggaatcggaacgatcatgcgttctaagaagatcttattagttgtcagcggagaagaaaaagcacaggcattaaaagacagtatttatggaccagtaacaccagaagtaccaggatctatcttaagattccatccagatgtaacaattattgcagatgaagcagctatgtcattgatcaaatagttgaatatgtgggataaaaatgaagattcaatctattaaaacagtgtattttagtgcgacaggaaatacaaagaacgtcgtaaagttaataggagaaacaattgcaaggaatatgaatctttcatataaagagattgattttacacttccacaagctcataaagatagctatgaatttacaaaagaagaactagtgatctttggaactcctgtgtatgcgggaagagttccaaacaaagtacttccgatgatacaaggattatttcaaggaaatgatgcatttgcagtaccagttgttacatttgggaacagaaactatgacaatgcattgattgaattaagaaatgaactagaaaacaatcattttcatacgattgcagcaggagtgttcgtagcacagcatgcttttacagatcaattagcaacgatgcgtccagataagttagataaggaagaaatcagagagtttgccaagcgtatcgtaacaaccatagaaaggatacaaactttgggagaaattccacagccagttaatgtaaaaggaattgagccaattccctcatattacataccacttgggattgacggcaaaccggcaaaatttttaaaggcaaaaccaaagacaaaaagtaattgcgatcactgtgatctttgtgtgaaagtctgtccaatgggatcgatcaattcagaagatccaagtaaaattgatggaatttgtatcaaatgtcaggcatgtgtaaaaaaatgtccaaaacaagcaaaatattttgatgatccggcatttttatcacatgttgaaatgttaaagagaaactatcaaagagctgctaaaaatgaaatttttgtgagtgatggcagagaaaatgaaatacaataatttttaatcaagtggatgaaaacatcatttttctgatataattaatttatcagcaaaatgatgtttttgctattttctttgcggatcataaattgaaattattctgtaaagatttcctccactttacaaaagaagcattttcacgcattttcaagattttgtgtccatcctttttatcaaatacgttatgggcacttgcgacaccaattcaaacaggaatcttaggccgcttatccgcagatgcgattgcggccaattctgtttctacgacgatgtttcagtatttgaaagttataaccatcggagaagcctcagcatctgctgtattaatcggaacaacgatcggggaaaacaaaggaactacaaaagtaaaagaatacagtaaaacactgcaagttatttatctgatcataggaagcgttcttggaatcagcctgtttttcttaaggattccattgttatctctctatgatctgacacaaaatgcatatcaaatggcagaccagattctgatcattttatccatcgtgatggttggtatgtcataccagatgccaacaggaattggtattatcaaaggcggtggcgacgtaaaatatatgatgtatctgaatctgatctcaacctgggcgatcgtgatgccgctttcatttttaggggcatttgtatggaaattgccagtaccgatggttgtgttattgctgaattcagatcagttgtttaagtgtataccaacgtatttgtatgtgaagaaggataagtggatcaaggttttggtttgatgatcaataccttgccatttgcagattcaaatgataagataattgataaaacaaaatcaattgcaacacactaaggcaatgaaacttttatgaataatctaaaaataactgcatatactctttcttaaaggagagtatgtgacattgaagaagaaaatagaaatcgcagtcatcctatgttccatcggcatctgcagctttggacaaaatgtcttcgcaggagaattcctaagattaccagcccaaaccaatgccaaagtagaacaagtggtgcagacaagacttttggaagaacaaagagcgtaccttatgcaggcacagcttatgacgaaagtcaatttagaacaacagattaaagacaaacccgtctatattccaaaaacaaagcatgtagtcacccaaagagaacgatcgattcttgagaggatcgtggaagcagaagcaaccgataaagatgaaaaaagcaagatacttgtagcaaatgtaattttaaaccgtgtaagaagtaaagaatttccaaattcaattgaatccgttgtgtttcaaagagcctatggaaaagtccagttttcaccgacagcagatggaagatatgaatctgttcgtatcacaaagagtacgaaaagaagcgtaaaaaaagcattagaagatggaatcgactattccgaaggagctttgtatttcgtagaaaaaacaatggcaaatcccaaaaatgtttcatggtttgatgaggcacttaccagattgtttacctatcaaggacattctttttacaaataatgcttgacaaggaaagataaaagtattatgattttaaacaaatagaaaagaaaccgttgagaaagagtagtaagcaggattagaatgattcaaagagagctgcaggtggtgagattgcagtatgatttccctggtgaatggactttcgagggtgattttgaaagtaacaagtaggaatcgccgggcacccgacccgttaccagagtgggcatatatgatagtatatgatttaagtggacacacctagtgtcaatttgagtggtaccgcggataattggcctcaagcatatttgcttggggcttttcttttttctatttgaagaaacgtacaacttaaataaaaaggagaagaaattatgagaacaatgaaaaaagtattagcagcgggattaacagcagttatggcaatgtcattaatggttggatgtggaagcaagaaagatgacagttcatctaaaacatataacttaggaatcatccagtttgcagaacatggttctcttgataactgccgcaaaggatttttaaaaggtttagaatctgaaggtatcaaagaaggagaaaacttaaagattacatacaaaaactcacaggcagatacagccacagataaccagatcgcatcaaattttgcatcaaagaaattagatatgatctgtgcgattgcaacaccaagtgcacagagtgcatacaatgcaacaaaagacagtgatatcccagttgtttatacagctgttacatcaccaaaagctgcaggatttgtagataaagaaggaaagaatgttggaaatatcacaggaacttccgatcttgtacttgcagataaacagttaaaactgattcgtcagatgatgccaaaagcaaagaatgtcggaatcttctacagcacaaacgaagcaaactccaaagcaggaatcgaagcttatgaaaaagtagctgataaatatggattcaagatcatcacacagggaatcacagcttccgcagatatgccaatggcagcagacagtttactgaagaaagtagactgcatcacaaacttaacagacaatttagtagtcagcaacatgcagacataccttcagaaagcaaacaaattaaatattccagttttcggatctgaagtagaacaggtaaaattaggatgtgtagcttgtgtcggaattgacttcgtaaaattaggaaaacagacaggtaagatggcagctaaaatcttaaaaggcgaagaaaaagcaaaagatatgaaatttgaaacatttaacaatggagatgtaatcattaatacagcagcagctaagaagattaatatgacaattagcaaagatgtgcagaaacaggcaaaacagacatttgacaagatcagcgcaccagaaaaataatcaggagatgtaaatattatggaacaattgatcataggcgtatttgagcagggatttatctatgcgatcatggcgcttggcgtatatatcacatacaaaatattagactttccggatctgtccgtagacagtactttcccattaggagcagcagtgacaaccgtcatgctctcctcaggaaagaacccactgcttgcattaattgcagcaacagcagccggagcaattgcaggaatggtcacaggaatcatacatgtaaaattcaaagtcagagacttattatccggaattatcgttatgacaggtctttataccttaaacttaagaattgtaggaggaagcgcaaatgttccattatttaactacaaatccgtatttgataatgacttcatcaacggaatcttcccagaagcattagcaccatataagacggtgatcattatttttatcatcatgatcattgccaaaatattattagacttatatttaaaaacaaaatcaggatacctgttaagagccgttggagataacgagacaatcgtaacatctcttgcaaaagacagtggatttgtgaagatcgtaggacttgcgatctcaaacggattagttgcattagctggaagtgttatgtgtcagcagcagagattctttgaaatctctatgggaactggaacgatcgttatcggacttgccagtgttatcattggaacaaacgtatttaaaggaaatcttatcaaagcaacaactgcagttgtcatcggttctgtgatctacaaagcatgtgtagcgatcgcgatcgaagtaggattaccagcaacagacttaaaattgatcacagcagtcttattcctgatcattctgatcatcagtatggaccgtaagaagaaggtgaaaaaggcatgattgaattaaaacatatcgacaaatattataatatcggaacagtcaatgaagtctgcctgttcaaagacttcaatctgacggtagatgacggagatttcatttccgtgatcggaagtaatggttcaggaaagacatccatgttaaatctgatctgcggaagcttagaagcggaagcaggaaatattattttaaatggagaagatatttctcatcaaaaagagtatatcagacagagaaagatcggacgtgtttatcaaaatccagcaatgggaacctgcccatctatgacaatccttgaaaatatgtctcttgcagacaataaaggaaagaaatttggacttggatttggtacaaataagaagagagttgactattacagagaattattaagccaattaggacttggactggaagacatgatgggaagtaaagtaggttccttatcaggaggacagagacaggcaatggcacttcttatgacaacgatggcaccaattgagatcttaatacttgatgaacatactgctgcacttgatccaaagacagcagaactgatcatggagttgacaggaaaagttgtcaaagaaaagaaactgacaacgatcatggttacacataacctgcgttatgccgtagaatatggaaatcgtattcttatgatgcatcagggacatgcggtacttgataaagttggagaagagaaagcaaaattagttgttgatgatcttctggatcagtttaatcagatcagtattgagtgtggaaattaaatttttaaattgtataacggaaatgtatcgagtattcataaaaacataaaaaaagatagaagtacgaaaaacgaattccattgacggattttttgcaaaacgctgatccgccaacactcctgcacaactcactgcgttcaaacagtgcccgtgttggctgcgattttgcaaaaaattctatggaatcctatcatttcgtacctctatctttttttatgtttttatgaatacctgaagacattctcgtataaaattaagaattttcaagcggaagggtgtgtatgttagacgttataatattccaccaataatttccgtcattcaaatcacaatcttgtgaagtctgtagacttttgttataatgatgttagatgatactaactatacgttagagaagactaacttctagaagcgaaaggaactatatatgtatttagaaataaaagatatgaaaaaaagcttcggatcaggcgaaagctataatcaagtactaaaaggaatcacaaccaacatcgaacaagggcagatgtgtgttatccaaggaaacagtggttcaggaaaatctacaatgctaaactgcatcggcggattagatactatggattctggttcagtcaaagtcgatggcaatgaaatatcaggattaaatgcagatgagctctccgaataccgcagagctaatctagggtttatcttccagttttataatctggtaccaaatcttacagtcaaagaaaatatagagatctgtcaatttttaacggaagatccattggatatggaagaactgctagatacgctcggactaacagaacatcaagataaatttcctgcacaattatccggtggacagcagcagcgatgtgcaattgcaagggcgttgattaagaatccaaagctgcttctttgcgacgaaccgacaggagctcttgattcgaaaacatccaaagatatcttgatcttattagagaagatcaatcagcaatatggcacaaccatgctgatcgtaacgcataataatgcaatccgcaatatggtacataaggttattatcatcaaagatggtcagatcagtgaagattacgaaaatgaaacaagattaccagcaaaatcactggaggatctttagatggaaaaagtattgagaaaaagagcatggagagatttaaaagaaaataaattccgctattttgcacttgcttttttgattattatcagtatgtatttggtcatcagtctggtaggtgcagcggatacgattgttgatggaactacaaagcaggcaaagaaacataagctggaagatggacagtttcaggtatttgtgccactaacgacaaaacaaaaagaaaactttacaaagaaagggcttacagtagaagagacattttatcttgattttagacaaaaagatggaagtaagttaagaatctttaagaatcgtaaaaaagtcaataaaattaatctggatgaaggtcgattagcaaaaaacaaaagtgaagttgttgtagaaaaacgatatgcacaagaacacaacttaaaaacaggatcaaagattacgattgacggcaacttctataaaataacaggaatcggatcagttccagactacgatgcatgttatgaaaagttatcagacagtactgtagacagcaaacagtttggacttgcatttgtgacagaagatgcttatgaaaatctaaaagacaatgaaaatagtattcagtctgaggaatatatctatgcataccgattaaatggtgcaatgactcagaaacagttgaaaaataaattaaagaagatcacatttaacccggatgatgtcgatgatccatattttaaagattactgggaagaaactgcaggaaagaaagatgacatcaaagacggaatcaaaaaacttacagatgcaagtacccagatgtcagacggattaaacaaactaagtgaaaacaacgaaacattgcaaaaaggtgccgatcagatttttcaggcatacttaaaaacagcagaaagtcagttgacctcctttggtgtaacatcattgacagaaaataattatgcgaatattctaaaaagtttgatcgcaaagtcaagtgatgggttgacaagattatccttagaatcagcaaaagaacagctggatgccttaaaaacatatagagatggaatcaaggcttatacaaatggtgttaaaaaagcatcagatggaagtagtaagttaaaagaaggaactgatcaattggaagaaggaacaaaagaactgatgaaagcatttgatatggaaacatcgaatctgactcagtttttaaaggcagatgacaacataagaattggagcagcggcaggtgatcaggtcattagtaaacttgctggaatggtagcaggtgtcatcattatgatcttatttacctatgtaatatctgtttttgtcattcatgaaattgagaaagaaaatagtattattggaacattgtatgcgcttggagtgataaagaagcagcttctaaaatattatttaacagttcctgtgatcgtaacatttctggctggattagcaggaacgatcattggatatagtccgataggaattccaacacagatgcaggattgttatgattatttttctataccagatttgagtccagaacttttaatctatctattggtgtatggaattgttatgccgccacttgttgcagtgatcgtaaactattttgttataagaaagaaactgtcaaggccagcactttctatgataagaaatgagcaaaagaagagtcatatttcaaaagtcaaattaggtgatatgccatttcttacaaaattcaggatcaggcagtcactgcgtgaggcaagagccggatttacggtagtatttggaatgtttattgcactgttggttatgatgatcggtctggactgttatgtgatgtgtgatcatatcagcaaagaaaataagaaagacacaaaatttgaatatatgtatacatataaatatccagataaaaaagtaccaaaaggcggggatgcatgttttgtaaaaggattgcataaagaagtatggggatataatcttgaaatttccctgatcggtatagaaaatgataatccatatttcagccaggataaagatcttccgaaagcaaagaacaaagttgttatttcatctgcaatggcacagaaatatgatctgaaaaaaggtgactcgatcatactgtctgatgaggaagatgaaatggattacgcatttcaggtagcagatatcacacaatattcttctgggttatatgcatttatggatatcgacagcatgagagatctctttcagacatcatcagattattacaatatggttgtatcaaagaagaaactgtcgattgactctggaaaactatatgcaacgacaagtaaaaaagcaattgaggagagttcagatgtatttatcaatatgatgattccgatgatgggaatgatcgttggactttctgttattatctttgcaattgtcatgtatttaatgatcaaggtaatgattgatcgttctgcacaaaatattgcgttgatgaaagtatttgggtatcggaagaaggagattaagaagctttatcttgatgggaatttctatatgatcgcagttggagcactgatcagtgttccattatctaagaaattaatggatgcaatgtatccagttatggtttccaatatagcttgtggtatgaatttaagtttcacatggcagatgtatgcattgatctatgcaggaattatcattacatacctggtaattaacaagttattagtgcgaaagatttacaaagtcggactttctgatgcgttaaagaatcgtgagtaagattaaaagaaacaatcagtttttgccatataaaataaactattgtataatgatacaaaaagaccaaagaaggaagaaacgatgacattacaacagctaagatatgtcgtaacgattgcggagatcggaacgatcagcaaggcagcagaagaactctttgtatcacagccaagtcttaccaaagctctaaaagaactggaaaaagagatgcagatcacgatcttcgaccgcacgaacaagggaattcatgtatctagagaaggagagatcttccttggatatgcaagacaggtattggagcaggcggcattgatcgaagagaaatataaacataaaagtggtgggaaacaggaattttgcatttcaacacagcattattcgtttgcagtcaatgcgtttgtagacttgatcaaagaatatggaagcgagaattatgatttcagtttgcgagagacacagacttatgaaatcatcgatgatgtagccagaatgaaaagtgagatcgggattttatatttaaatgaattcaatgcatcggtccttgagaagatcatgaaagcaaatgatctcaaattcacagaactatttgttgcaagaccacatatttttatctgcgataagaacccgctggcacagaaagatcaagttacgatggaagatctcaaggattacccgtatctgtcatttgagcaaggggaacataattctttctattattcggaggaaatgtttagtacggaagtgcgttcaaagaacattcgagtgagagacagagcaactctgtttaacttactgatcggactcaatggatatacgatcagcagtggtgtgatcgataaggaattaaatggagagaatattatcgcagttccgcttgcagaagaaggcgagatgcatattggctatgtgacacataagaagacgaaacctagcagattaggggcgatttatctggaagcgttgaagaggcatgcacaataattttatatatgcttaaagaaaggtcataaccgtatcatggtagagatacaggttgtgaccttttgtgattttatggtataattttcacataaaaaacgaaaatgaagaagaggaagtaagatgattacgggtgaattaaaaaacaaagtagataagatatgggagattttctggacaggtggaattacaaatccactggaagttattgaacagtttaattacttactatttatcaagcagttagatgaggtagaaaccaggaaagaaagagatgcgaatattttagggattccatatgaaggaatctttccagctgattgtcagcagtatcgttggagtaaatttaagaatttgggagatgcgaatgagatttatgatctgatgatgaatggagtatttccgtttattaaaagtctacatccagatggagaatctgcttatagtaaatatatgggagatgcgatctttaagattccaacgccagcattacttaccaaagtaattgatgggattgatggattgaatctggaaggagacagtaaaggagatttatacgaatatctgttatccaaactggaaagtgcaggaaagaacggacaatttcgaacaccaagacatatcattcagatgatggtagaactggtaaaaccagtaccatctgatatcatctgcgacccggcaatgggatcagcaggattcttaatggcagcacagcagtatttgcgtaaaaaccacaaagatttattcttaaatgcggaacaaagagagcattttaatcatgagatgttctatgggtttgatatggaccgaacgatgcttcgaatcggagcaatgaatatgctgcttcatggagtcgatgatccgaatattgaatacaaagacagcttgtcagagatgaatacagataaagaaaagtattcattgattcttgccaatcccccatttaaaggaagtttagactatgatggagtatcagcagatcttttaaaagttgcaaaaacaaagaaaacagaattattattccttgttttattccttcgcatcatgaaaattggaggaagggcagcagttatcgtaccagatggagtattattcggaagcagtcgtgcacataaagcgattcgaaaagaattaattgaaaatcataaattagacgcagtgatttccatgccatcaggagtgttcaaaccatatgcaggagtatccacagctatcttactcttcacaaaaacaggagcaggtggtaccgataaagtttggttttatgatatgaaagctgatggaagaaccttagatgataaacgtcaggaaattgaagagaatgatattcctgatattattgagagatatcagaatctagaaaaggaagaagaaagaaaacgaacagaacagtctttttttgtgccgaaagaagagattgtcgagaatgattatgatctttctattaataaatataaagagatcgagtatattccggtagagtatccaccaacagaggaaatattgaaagatattgaggaattagaggtggaaattcataagaatctggtggaattaaggaaaatgttggaagaaaatgatgattagcagatagaaaaatttgaatttgtattttgaactatattaaacaatataataatgcattgacaagtgggcgagatgatgatattctataaatagaaaagatgctaccgatagacggttagcctgatattataagtcgaaatagtcgctcatttacaggttggggcggctatttttttgtcttggaatcacgttgtccatgtgaataaccaagactataaaaagtcgtacaaagacaaataatgccgatgaggttatcaatagtcaacataagtcaaatcctcctaagtaaatttccaaaataattggatttctatgtaaaccggactataacttccggataggaggctaaccgcctaccgttatggtaacatctatagttattatactggataaaaatatagatatcaataacaaaattaaatttaaaagtgaaattataagcgaatttgaggaaatgatagatgggaaaagtaaaattaggagatatagctgtattaataaatggtgatagagggaaaaattatccatcacaaaaagaaattataacgagtggtggaatcccgtttgttaatgcgggacatttaaatggtcgagcgatagagtttgaagcaatgaattatataacgcctgaaaaatatgagaaattaaattccggaaaatttcaacaaaatgatattttatattgtctaaggggttctttgggaaagaaagcacttattaatgacaacatatatggggctattgcttcatcacttgttattattagaccgaatttagaaaaagtacgaccacaatatttgatgttagctttggaaacacctctaattaaagagcagttatttaaatttaataatggaagttcacaacctaacttatcagcgaaaagtgttaaagaatataaattggaattacctgatttatttattcaagatagtataattagtaagttggaaaaggttagaaatttaatagaagatgaaaaacaggaaaaattgttattagataatttaattcaagcccgatttgtagaactctttggtgacgctgtatacaatgataaaaaatgggaaacagatacagtaaaaaatttatgcaaagagatatatggaggtggaacaccttctaaagctcatccagaatattataaagatggcgatataccatgggtatcagctaaagacatgaagacagatgtattgaaagatagtcagattaaaattaatcaattaggtgtagataatagtactgcacgtttggttcctgtgaattcagtaattatggttattagaagtggaattttaaaacatacattgccagttgcagtgaataaagttcctataacagttaatcaagatttaaaagtatttataccaggagaaagaattttgacgaggtttttagctgttcaatttaagatgcaagaaaaagatattttgtctggtgttagggctgtaacagctgataacatagagtttaattctttgaaacaaagaagaatgattgttccgccaatagatctgcaacagaagtatctaatgtttcttgaacgaatagacaaatcgaagtttgaagttcagaaatcattagaaaaaacacaattactatatgattcattaatgcaagaatatttcggatagaaaagaggcgatattaaaatgtcagaatttaaacgatggttaattgaacgttttaaaatagaacgaaaacgatttgacagaacaggagtttatgcttatacgcaaagagcaatggcgtacaattcaaataagattgaaggaagtacattgacaccagaacaaacagcatcactatttgataatggaacattaccagtcaacgatgactattatcgagccaaagatgtagaggaaatgaatggacatttcttaatgtttaatcatatgttagatacattggaagaagaattaacagagaatctaataaaacgcatgcattatgagttgaaatcaggagtttttgaagatcgagcgaatggatatgcaatcggagattataagaaacgtcccaatatgatcggaatgtataaaacagcattgccaaaggatgtagaagcagagatgaggcaacttttggattggtatcataaacaagaaaaaactatgaaaacacttgctgaatttcatgcaagatatgaatcaattcatccatttcaggatggaaatggacgaacaggaagaatgatattgtttcgggaaagcttgaaatatgatgagttaaaaccatttattatcttagatgatgatcgcagtaagtatttagaaggactaaaagaatatagagaacatcataaagtggatcaattattagaattaatgcaaaaagaagctgaaacatattatcaggaatgtcaatattttatttcatagatttaggagcaaaaatggttgaaggatgttggtatataggagtgtaccaacatggaagagaaaattgtaacaatactaaatgagatggcagagtatttaacagtgccacagatgaaaaaattacaggaagtaattctaaggacattttcagaaaatgaactagagaaacaacagatatcgaatgaagaatttctggaaatgttcttggatgcaaaaagagtagaaggatgttcggaacgtaccattcaatattataaggtaacagcagaacatatgctttcacaaacggaaaaagaaatccgcaagataacgacagatgaaatgaggtcatatcttgcagattatcaaaaaaggaataactgctcgaatgttacaattgataatatacgacggaatatatcgagcttttttacatggttggaggaagaagattacattttaaaaagtccaatgagaaggattcataagattaagacaaaaacagtggtaaaaagtgtgatcacagatgaaggaatcgaacaattaagggatcattgtacacagattcgagaccttgcaatgattgatctgttatattcaacaggtatacgtgtgggtgaattggtaaatttgaacataggagatattaattttgaagaacgagaatgtgttgtatacggaaaaggagataaagaaagaagagtttattttgatgcgaaagcaaaagtacatttaatggaatatatagaaagtaggaaagataagaacccagcattattcgttactttagatgcaccatatgatcgcttaaagatcagtggggtagagattcgattaagacaattaggaagagagcttggattggaacgaatccatccgcataaattccgaagaacaatggcaacgagagcgattgacaaaggaatgccaattgaacaagtgcaaaagattcttggacattcacagattgatacaacgatgcaatatgcaatggtaaatcagaataatgtaaaggcatcccatcagaaatatatgtcataaccagataaattgaagattcattccttaaaatttgaatttgtattttgaactatattaaacaatataataatgcattgacaagtgggcgagatgatgatattctataaatagaaaagatgctaccgatagacggttagcctgatattataagtcgaaatagtcgctcatttacaggttggggcggctatttttttgtcttggaatcacgttgtccatgtgaataaccaagactataaaaagtcgtacaaagacaaataatgccgatgaggttatcaatagtcaacataagtcaaatcctcctaagtaaatttccaaaataattggatttctatgtaaaccggactataacttccggataggaggctaaccgcctaccgttatggtaacatctatagttattatactggataaaaatatagatatcaataacaaaattaaatttaaaagtgaaattataagcgaatttgaggaaatgatagatgggaaaagtaaaattaggagatatagctgtattaataaatggtgatagagggaaaaattatccatcacaaaaagaaattataacgagtggtggaatcccgtttgttaatgcgggacatttaaatggtcgagcgatagagtttgaagcaatgaattatataacgcctgaaaaatatgagaaattaaattccggaaaatttcaacaaaatgatattttatattgtctaaggggttctttgggaaagaaagcacttattaatgacaacatatatggggctattgcttcatcacttgttattattagaccgaatttagaaaaagtacgaccacaatatttgatgttagctttggaaacacctctaattaaagagcagttatttaaatttaataatggaagttcacaacctaacttatcagcgaaaagtgttaaagaatataaattggaattacctgatttatttattcaagatagtataattagtaagttggaaaaggttagaaatttaatagaagatgaaaaacaggaaaaattgttattagataatttaattcaagcccgatttgtcgagatgtttggtgatccaataacaaacagtaagctattgccgattgaaaaaatagaagaaagatattttttaaaggcaggaataacaactaaagcagaagatattcatgattatttaaaagataaatatgaaataccatgctatggtggaaatgggataaggggatacgtagaaaatttaagttatgaaggatgttatcctattataggtagacaaggagcattatgcggtaatgtacaatatgcaacaggaaaatttcatgcaacagaacatgcggttttagtttctacattaaaaaatgataatacaatgtgggtttattacatgttaaaattgatggatctatatagatatcatacaggagctgcacaaccgggattagcagtaaaaaaacttaatacaatagatgttattgttgcagacataaaccttcaaaaccaattcgcagccttcgtccaccaaatcaacaaatcgaagtttgtcatccacaaatttctatattgcaccacccacaatacaaagagtataataaaaccaagaccaaataccaaagaatcaggaaaaataagggggagggaaaccacatgcagacgaattttgactttctagtacagacagatcgtttcaaagactttgcgatgcaggcagcagaagcggaacgaagcatcgccatatctccgtcaacagcagcaatcttgtcaagacgagccttagaactcgcagtgcgatgggtatatgtccacgatgatgccctgaccatgccatatcgtgataatatttccagcctgattcacgaatattctttccgcaagctgattcagcctaaattatttgatatgctaaaatatacgattaagcttggaaatgtcgcagtacatacaaatactaacgtaaaacacgatgcagcggtactttcgttacgctgtgttttccagttctgtaaatggattgattactgttatggtgaaaactatataaatcgccattatgatatgagtctgctgccagatgccggaaaagagaaaaaaacacaggaagaattagaaaatcttcaaaaagaactaagcggaaaagaccagaaattagaagaagcgatcaaggaaaatgaaaagctaagagaagagatgaccaaacttcgtaaggaaaatgaaactggacgaagttatgaagtggataaagatacagaagcagagacaagaagaaaatacattgaccttgatcttgcggaagctggatggacgattggcaaggactgtcttacagaagtgccagttacaggtatgccaaacagtacaggaaaaggttatgccgattatgttttatacagcaataatggaaaaccactggcagtcatcgaagcaaaacgaagcagtgtagatccgatgaaaggaagtcatcaggccaaattatatgcggattgtctggaaaatcaataccagcaaagaccaatcatttttataacaaatggttttgaaatgcagatcattgatgatgcacaggatgatccacagcgagttgtttcaggtattttcacaaaagaagatctgcagcgaatggtggatcaaagaacaagcaaaaagcctttgattcatttagagattcaagataaaattacaaaccggccatatcagaaagaggccgtgacggtattatgtgaatctatcatgaatcatcatagaaagctgttgctagtacaggcaacaggatcaggaaagacaagggttagtatcagtctggtagacgtacttcgcagacataattatgtaaagaatattttattcttagcagatcgtaaagctttagtttctcaggcaaagaagagttacagtaatctccttccagacttgacagtatgcaatttacttgaaaataaagaagatccagaaagcagcagaatgatattttcaacatatccaacgatgctaaatgcaatcgatgaaacaaagaaaaaggatggaaaaaaattatttacaccagcgcattttgatctgatcattgtagatgaaagtcatcgaagtatttataagaaatatcaggaaatctttcactatttcgatgcggttttacttggaatgacagcaacaccgaaagatgagattgataaaaacacctatacgatctttgatctggagcgaggggttccaacgtatgcgtatgagcttgatgaagcagtaaaagaaggatatctggttgactatcgaacaagagaatataagacaaagatcatggaagaaggaatccactatgatcagttatctgaagaagaaaaagaagcatttgacgatgaattcgatgatgatgagaatgtagagaaagatattccgaatacagctgtaaatcgatggctgtttaataaagacacgattgatcttgtgttaatcaatctgatgagagaaggattaaaggtagaaggcggagataaattgggaaagacaattatttttgcaagaaatagtaaacatgcgaaggcaattgtcaagcgttttcagaagctttttccagagaaaggcagtcattttatcaaacagattgattacagcatcaaagagtccgaacatttgattgaacaattcgaagaaaaggacaagatgcctcagattgcagtatccgtagatatgctggacacaggaattgacgttccagagattttgaatcttgtatttttcaagaaagttagaagttatgcaaaattctgtcagatgatcggaagaggaacaagactttgcaaagatttactagggcctggaatggataaagaaaaatttctgatttttgattattgtaataacttcgaatatttcagagtgaatccgcatggaaaagatagcggatttatagaaacattagcagagaaaatctttttatgtaaggcaaggatcgtaagagaattacaagatacagactatcaaaaagacgaagatttcagagaatatcgaaatacattagtgaaagaattaatgcaagcgataagtgatctgaatgacaaaagtttcattgtaaaacatcatttgaaatatgtccttcgatatcgagaacagaaatcatgggatattcttgagacagaagcaatggctgacctgaagaaacatatcgcaccaattatagaggccgagaaggaatatgaattggcacgaagatttgattatctgatgtatagtatcgaacttgcaatgctggaacagaagaacccttcgaaaaatattggagcagttgttggtattgcagaaaagctatctttaatgcaggattctgtgccacagatcaaagagcaaaaatatattttggataaggtacagacgaatgaattctgggaaaaagcatttattctggaaatggatgtagtcaggaaagcacttagagatctgattcagtttttaccaaaaaagacacagagaatcgtttatacagattttgcagatcaagtaatagaatatcaggaaaacacaccaattgagatgggaaatcgattagaaaactatcgcaaaaaggtagaattctatttaaaagagcatcaagataacatggcagtgtgtaaattacgaaataaccagccgttacaaaaaagtgatatgcaggaactggagagaattctttggcaggaactaggatcaaaagaagattatacaaaagaatatggggatacaccagttggaattcttgtaagaaaaatcacaggaatggatcaacaggcagcaaatgaggcgtttaatgaattcttaaatgaggagaaactaaatgctgatcagattcgttttgtgcgattgatcgttgattatatctctgtaaatggaatgatcgaagaccgaagagttatgatggatgagccatttcgaagtgtcggaagtattggacagatttttgaaaatgatatggacatcgcaatgaagatcatgacagtgatcgatcagatcaagcagaatgcggaagttacagtataaaggagggatcagcatggcaagaattgtcggaattggacatcaggattttgaaaccgtccgaagaaagaacaatttttatattgataaaactgaatttatcaaagaatggtgggaatctgatgatgcagttacgttgatcacccgccccagacgttttggaaaaacgctaaacatgagtatgcttgaaaagttcttctcagtagaatatgcccaaagagcggaattattcgaaggactaagcatttggaaatacaaagaatacagagaaattcaaggaacatacccagttatatttctaagctttgcaaatgtaaaagaaaatacttacgaacaggcaagagaaagcatttgccgcatcatacaagagctttataataaaaatatttttcttcttcatacggatttgctgacagataatgagaaagaagaatataaacagatttcaaccaaaatgaatgacagcatgatttctgatgctattcgaaaaatgtcagattatctaagccgctattatggaaagaaaacgatcattttattagatgagtatgacacaccgattcaggaagcctatgtaggcggattctggccagatttgatgggagtcttaagatctctgctgaattctacatttaaaacaaatccatatctggaaagagcaatcatgacaggaattacaagagtcagcaaagaatccatcttttccgatcttaataatctggaagtagtaacaacgacttcaaagaaatatgaggataagtttggttttacgcagaatgaagttataaaagctctcaaagaatatggattagaagataaaaaagaagaagtaaaacgctggtatgatggattttgtttcggagagatgaaagatatctataatccatggtcgatcataaattatctagacaagaaagaagtagctccatactgggcaaatacaagcagtaattctttgattggaacattaatccgtgaaggaaatacacaggtaaaagaatcgtttgaattattattaagcggaaaagaaatcattacagaattagatgaacagattgtttatgatcagctggatcttgaggaaacagcaatctggagtcttttgctcgcaagcggatatttgaaagtagagaaaaagataagaaacgattcggattatctaaattggaagcagttatatcgtttaaaattaacgaatttcgaagtgcaagtaatgtttgcgcatatggtaaagaattggttttcaaaagcaggtggagactataatgcatttatcaaagccatgttagttggtgatatagaagcaatgaatgcttatatgaaccggatatcaatgcatattttcagttatttcgatgtaggaaagaaatcgtcacagatgctggaaccagagcggttttatcatggatttgtccttggacttctggtagaattaatagaccaatataagataaaatctaatcgtgagagtggctttggaagatatgatgttatgttaaggcctagaaatgtgaagaaagataaagcgatcatcatggaatttaaagtgctcagtcctaagaaagaaaaatctttagaagaaaccgcgcaaaatgcattagaacagatcaaagaaaagaaatacaaagaagagttgatcgaagcaggaatcaacgaaaataatatcaaagcctatggttttgcatttgaaggaaaaaatgtcctaatcttagattaacctgattataacaaagaaaggtagaaaacaatggaacagcagcagccagaaaagaaacacaaacgaagagtcagatataaagggactcatccaagaagattcgaagaaaaatacaaagaattaaacccagaaaaatacggagatacgattcaaaaagttattagtaaaggaagtacaccggcaggaatgcacatttccatctgtgtaaaagaaattcttgaattttttgacatccagccgggacaaaaaggattggatgcaaccttaggatatggcggacatacaagaaagatgttagaaaagttacagggcaaaggtcatatctacgcattagatgtagatccgatcgaatctgtaaagacagagaaacgtctgcatgatgcagggtttggagaagatatcttaacgatcaagcatattaattttgctaatattgatcaggtagccgaagaagttggaccattcgatttcattttagccgaccttggcgtatcctccatgcagattgataatccggaaagaggattttcttataaatttgaaggatcattagatttaagactgaatccagaaaaaggaatttcagcggcagagcgtttagaagatatcacgaaggctgaatttgaagggatgctcattgaaaatgcagatgagccgtatgcaaaacagattgcaaaagaaaccgttgcaacgatgaaacgaggaaagaagatcaagacaacaacggatcttaaagatgtcattgaaagagcattaaactttttgccggaaaaagagcgaaaagaagcagttaaaaaatcctgccagagaacatttcaggctttgcgtattgatgtaaacagcgagtttgaagtattagaagaattattggagaaacttccagacgcattagcaccaggtggaaaggttgcgatccttacattccactctggagaagatcgacttgtaaaacatgcgtttaagtatgggaagaaagtaggaatctacagtgatgtagccaaagatgttattcgtccatcaaaagaggaatgtgcccagaacggaagagcaaaatcaacaaagatgcgctgggcgatcaaagtgaaataaaaattaaaaggaagggaaatattaaaaagaggtatgctttttaatatttcctttttttaaaaatatgaaagaaaatggtttaaaatgattgactttgactgaaactgtgttataatgaagaaaaaaaagaaacaaatgattgattttgacgtttttttattttggaaaaggaggatgacctgtatgagaattacagagctgttgcaggatgcaacgattgaccttggcgtgaaggttaacagcaaagaagaagcaattgatcatctggttgatttaatggtcaagggcggaaacatcacagatcgcgaagaatacaagaagggcattttagcaagagaagctaatggaacaactggtatcggaggagggattgcaattcctcattctaagaacaaagcagtaactaaggctggtttggcttctatgacagtaccagacggagtcgattatgaagcaatggatggagaaccatctgacgtattttttatgatcgcagcaccagcagaaggaagcgacgtgcatttagaggcattgtcaagattatctgtgatcttaatggatccagtatttaaggacagtttattaaaggcaacaagcaaggaagaatatcttgcattgattgacaagaaagaaacagaaaaattcccagaagaggcggcgaaggaagaagagaaacctgctgtacaagaagagaaagcagacgatggaacgatcagagttcttgcagttacagcatgcccaacaggaatcgctcatacattcatggcagcagaatctcttgagaataaagcaaaagagatgggaattacattaaaagctgagacaaatggttcaggtggagcaaagaatgtcttaacaaaagaagagattgaaaattgtgatggaatcatcgtagcagcagataagaacgttgagatggcacgttttgatggaaaacaggttcttcagacaaaagtagcggacggaattaataaaccagaagaactgatccagacaattttagataagaaagcgccaacatatcatcattcaggagcagcagcacaagaagatagtgcagaaggtgaaagcgttggacgtcagatttataaacatctgatgaatggtgtatctcatatgctgccatttgtaatcggtggaggtatcttgatcgctcttgcattcttagtagataatcaggcgatcaacccggcaaacttcggtaagaatacaccacttgcagctttactaaagacaatcggtgaacaggcatttggatttatgcttccaatcttagctggatttattgcaatgagtattgcagaccgaccaggattagcgataggtttcgttggtggagcattagcaaatggtggttatacatttgcaaatatcatggcatatgattctgccaaagccgtttcctctggatttatcggagcattatttgcaggttttgttggtggatatatcatggttttattaagaaaactgtttgataaattaccaagtgcattagaagggttaaaaccaattttactattcccagtttgtggtattttaattatgggtgttgtgatgatcgcagttaatccggttgttggagcgatcaatacaggactgaataacttcttatcatctatgagtggaacaagttctatccttttaggagcagttcttggagcgatgatgtccattgatatgggtggtccatttaataaagcagcgtatgtatttggtacagcacagttaacagtagccaatgcaggaccagaacagtatgcgatcatggcagctgttatggccggaggaatggtacctccacttgcgatcgcactttgtacaacattcttcaagaatcgttttacagagagtgaaagaaaatctggtgttgtaaattacatcatgggattatcattcattacagaaggagctatcccgtttgcagcaggagatccaatccatatcctgccaccatgtatcgtaggatctgcagtagcaggtgcgttatccatggcatttaaatgtgggcttccagcaccacacggtggaatctttgttattggagtcatcacgaatccagtacaatacttaatttctgtagtagttggtgcagttattggaatgatcgttatgtcatttacaaagaaaccattaaataaataagattgtaaataaccatttacaataaattaattcctcatattttcataagcaatatttataataagtaaacagagattgtgaaattttgcaatctctgtttgctattttgataaaacaatgatatactagataagattttagaaatcaaagacagttcattcgtaccatcctgtctataaacaaaactaggactgagaagaagattttcaggatacaggtacgcgtgcttgtatccttttttaattgaaaatatatgtagaagggaaagaagaaaatgtatcagttaacaacacatgcatcctttgattcagctcattttttatcgggttatgaaggaaaatgcagcaatatccacggtcaccgctggaaattagaagttaccgtacaaagtgaaacattagaacagacagggcagattcgaggaatggttgtcgattttggacagttaaaagatgatattaaaaaattagcagatgagtttgatcatagtctgatcatagaagatggaacattaaaagagaagacagtagaagcattgaaagaggaaaatttcaaaatgatcttcgtagattttcgtccaactgcagagagttttgcaaaatatttttatgatagagtgaaagaaatcggatatgatgtcaagttagcgaaagtttatgagacaccaaataatatggcagcatatggggagtaaatgagatggaaacatttaaagtagtcgaaacctttgtaagtatcaacggagaaggaaagaaagctggtcgtcttgctatgtttatccgattgaaaggatgtaacttaaactgttcttactgcgacacaacatgggccaataaaagagatgcaagatgtgaattattgacggcaccgcagattgtagaaaggatcaaagaagcaggggtcgaacttgttacattaacaggtggagagcctcttcttgacgaaaatgtatcagaattgatcggaagtatcttgatgatgccaaaagttgagattgagattgagacaaatggaagtgtaccgatcagatattataaagaaagagacaacagattaacaatgacaatggattacaaacttccatccagtaatatggaagagaatatgtgccttgaaaatatggaatatttaaaaccatgggatgttgttaaatttgttattggaagcagggaggatttaaacagggcgaaagaaatcattgaacgattcagactttgtgaaaaagcaattgtatacttcagtcctgtatttggtaaaatcgaaccagaagaaatcgttgaatttatgaaagaaaacaagcttaacaaagtcaggttccagattcagatccataaagttgtatgggaccctgacaagacaggtgtataggaggaaatactatggcaatcgataaagaagcgatcaaggaacatataagaggtattcttgttgcacttggagatgatccaaaccgtgaagggttaaaagaaacaccagatcgtgtagcgaaaatgtatgaagaagtctttgaaggaatgaattacagcaatcatgagatcgcacagatgttttcaaagacatttgaagatgatctaagtgtcaaagatcataaagatatggtgatcgtaaaagatattgatatctttagttattgtgagcatcatatggcattaatgtatgatatgaaagtctctgtggcatatttgccaaaagacaaggtattaggacttagtaagatcgcaagaatctgtgatatggttggaaaacgtttacagcttcaggaaaggatcggaagtgatatcgcagagattatcatggaagtttcaggaagtgaagatgtagctgtttatattgaaggatgtcatagctgcatgagtgcaagaggaatcaaaaaacacaatgccaagacagtgacaacaacatttcgaggagcatttgacacagattctacattaaaatggcatttcatgatgcaggcaggaaaataagaaaaggagagaagcaaaatggcaaaaccaaacaaggccgttgttgtattcagcggtggacaagacagcacaacatgccttttctgggcaaagaagaaatatgatgaagtgatcgcgctttcatttaattatggacagagacattcaaaggaactcgagtgtgcaaagaaaatctgtaaagaacacggtgtagaacatcatattctggatatgggactgttaaatcagttagcaccaaactctcttaccagagtggatatggaagtggatcatgaagcaccagaagaaggaacaccaaattcatttgttgatggaaggaatatgttattcttaacatttgcagctgtttttgcaaaacaaagagatattcatgtgttagtaacgggtgtttcccagagtgatttcagtggatatccagattgccgccatgtttttatctcatctttagaaacaacattaacacttgccatggattatgagtttgaagtgatcacaccactgatgtggattgacaagaaacagacatgggagatggctgataaattaggcgtctttgatattgtaagaaatgaaactctgacatgttataatggagtgatgggtgatggatgcggagaatgtccagcatgtaagttgagaagacatggattagaggaatatttaaaagtccgtggacataaataaaatatacgaaagagaaaaggatcttgtgatggtacaaggttcttttttgttgtttatatatatgaatgatgaaagtgtcgaaagtataaatagcaaaaagctgcaagaaaagtattgataaaattttaacaatgatgtacaatgtatttgtagcaaaacaatcgattgaaatcggatattcaaatgttggatatataagaaaaggttcaatttcggtcatccaggtaaaggagatgttagttatggcaagatttacattaccaagagatttatacttcggagaaaacgcattagagacactaaaaacaatcaaaggaaacaaagcagtattgtgcctgggtggcgggtccatgaaacgttttggatttgttgacaaggtcgttgaatatttgaaggaagcaggaattgagacaaaactgatcgaaggaatcgaaccagatccatccgtagagacagttatgaaaggtgccaaagtgatgcaggaatttgaaccagacctgatcattgcaatgggtggaggatcaccaatcgatgcagcaaaggcaatgtgggtattttatgaacatccagagacaacctttgatgatatcaaagatccatttaccattccgccacttcgtaacaaagcaacctttatcgcaattccatcaacctcaggaacagcaacagaggtaacagcattctcagtgatcacagattacagcacaggaatcaaatacccactggctgatttcgagatcacaccagatgtagcgatcgtagatccatcacttgcagagacaatgccacagacattaacggcacatacaggaatggatgccttaacccatgcgatcgaagcatatgttgcaggattacattccccattctcagatccattagcgatccatgcgattgagatgatctttgataacctgaaagcatcctatgaaggagatatgcaggcaagagggaatatgcatatcgcacagtgcttagcaggaatggcattctccaacgcgttgcttggaatcgtacattccttggcacataagacaggagcagtctttgatacaggacatattcctcatggatgtgccaatgcaatctatcttccatatgttattcagtacaatgccaaagtctgtgaagacagattcgcaatgatcgcaagaaaattaggacttcctggagtgactgataaagcactgactttatcactgatcaaagcagtagaagatctgagaacaagtcttcatattgtgtctaatctgaaggaatttggcgtaaaagaagacgaatttcttgagaagaagcatatgatcgcagagagagcggttggagatgcttgtacgggatctaatccgagagaaacatctgttgaggatatggagaagattctggaatgtatttattatggtaaggatgtaacattctaaattttaattttgtaagttggccaactgtagattttgagtatatgataaaaaataaataaacgatcggaagagcagcattagaattttcctcttccgatcgtttatttattttttatcatataccagaagtctaaagtgtggacgattacaagattgaaaaatttaagtggggtgtatgttgagtgttatcgtttttcaatttttgtagcgacagacagtgtttattataaataccaatacagtaaaacatacacactgtgtggtggtttgaatagacgaagtcggtaaaataatgtataataagaaccaaaataaggaggaatccaactcatgggaagatatctaaatagttcaactccatatgcattatatcaaggtgaaacaaatcagccatattttgtagataaatcattattactggcagaattgtttcctgttttggatgcaggcaatcagcatatttgtattacaagaccaaggcgttttggaaaaacgatcatggccaatatgatagctgcatttttgagtaaaaaagtggattcagattcgatttttagcagactaaagattaccagtaatcttaaatataaagaatacagaaataaatataatgtaatttccatcgactttagcaagatatcaagatcctgtgactcatattctgattatataggaaaaatcgagacaactttgatcagagatcttaagaaggaatatccacagattgaagtgtatgaagatgattcggcagcggatgtattagaaacgatttttgaagaatgtaaccaggaacgctttgtttttgttctggatgaatgggattttatttttcataaagattttattaacgaagaaaataaaaaacagtatatccagttcttaagtaatttattaaaagaccgtccatatgttcaaatgacttatatgacaggaatccttccaatcgcaaaatattctgatggatcagaattaaatatgtttgatgagtatgatatggcatgtaaagaaaaatacagtgaatattttggctttttggatgaagaagttgaccagctttatgacatttataaaaagataacaaagaatccgaagattttaagaagtgaattaaaagaatggtatgacggttatcgggcggcagcaggagattatttgtataatccaagatcggttgtttgtgcattaagagataaccaactggcaaactactggacaagttctggaacttatgattctattttcaactatattaaagggaatatagcagatgtgcgaaatgatcttgtgctaatggtcgcaggagaacatgttccagcaaaaatgcaacaatatgcagcaacagcaaatgcgttgcataccaaagaccagatttattcagcaatggtcgtttatggattgttgacctatgagaatgggaaggtatttattccgaacaaagagttgatggacaaatttgatgaattgctgttatcaaaccagcaattaggatatgtttaccgattggcaagagaatctcaacgaatgcttcaggcaacaattcatggggatacggatacaatggaagagattcttgaatacgtccatgatacagaagttccgatttattcatataatagcgaagtggaattatcagcaattgtaaatttagtttacctctctgcaagagatgaataccgtgttgagagagaagacaaagcaggaaaaggatttgtggattttatcttttatccaaaaagaaataatatacctggaattattctggaacttaaaatagatcatacaccacaaaaagcgatagagcagattaaagagaagaattatcaactaagattccaaggaaaaattggagaaattccagtatatgaaggaagtatattagcagttggaatcagttatgacaagaaaactaagaagcatagttgtgaagtagaaatgttgtaaaagggtacataatcaattggatgttaacgaagaaaaagcagaattccaatgcatcgctttcggttgcttatttattttttatcatatacctgaagtctatagagtggacaattcacaagattggaaaatttaaggtggtgtgtatgttttactgtattgtttatatatttaggtaatcgatagctgaaaattctcgcaatttaaggtttcgtagaaattaagataagagaaatttcaaacatctcgataaatcggtgtctaagagttcctttatcttctgttaacgaataccaaacttatcagccaatacaataaaacatacacactgtatagtggtttgaatcacgtaaattatttgaatattataaaaagagatcatgtgtcagcaaccgtacggacacgtctgcacttagcgagtggatggtcgttagaccattcaggagcttagtacagctacgtgggagtccgaacgcaagtgggttgcaggcacatgatctctttttataatattccaccaataatttccgtcttcaaactacaaatcacaatttctgaaacgacttcaattccttcaccgcaaatgttatcgcacataccgcagcaaatccatctgcgatcggtgctgagaacataactccctcaattccaaagaagatcggcaaaatgatcatcaaaggcagcaagaaaataacttgtctggtcaatgaaaggaaaataccacgatttgcctttccaattgctgtaaagaagtttgcagtaattggctgtaatccattaataaaggtacaaaacaagaagattctgaaaaacttctctgcaaaacggaaataagcttcactttcagacccaaagattccaatgatctgtcgtgggaacagctggaagcagatgaaagaaactgtgctgatgatcgttgcagaaatcgcagctttcaaataagcctcacggacacgatctagctttcttgcaccatagttataactgataattggctgtaatccttgagaaataccaatattaatcgcaaaaaagatcatattgatcttcgtaatgattccggcacatgccaatggaatatcgcttccgtaagaagattttgcgccataacggatcaaaacattgttcataacgatctgtacgaccatcatggaaacctgattaaagaatggcgccataccaagagaaacgattcttcctatataatgaggatgtggtcttaacttttcttttgtaagttttactgttttaaattttcttaaatataaaataaccatgattccagatacgacctgtccgatcacggttgcccaagcagcaccagcaattcccatgtggaaaccaaagatcaaggttggatcaagaatcgtattgatgatcgcaccagttaaagggcaggtcatggaaaactttggacttccgtcagcacggacaaggttcgtaccacctgttgttaagatcaaaaatggaaatccaagagatgtaatacctgtatagattaaagaataatctaaaacactagatgttgcgccaaataagatcatcattggttttaaaaataatcttgttatgatacaaaggatcataccaagtgaaaaaagcattgtgattgcatttccagcgaaggaagcagccttctctttttcttgttggcccatgcaaagattaaagtttgcagccccgccgattccacacatcaaggcgatggcagtacaggtgataactaaaggaaaggcaacatttgttgctgcattcccaagcatcccaacacttcgtccaatgaaaaactggtctaccatattatataaggcacttacgaccatagcgataatactaggaatagcgaaacgaagaagcaaatttgatatcttctcggtaccgagcggatttgtcttttgttcgttcataataaataaaacctcttctttctataatatatataatataaaagattgtcgaaacgatcgaaaatggtcgaaacggacgttatctagtatagtataaatgacaaaatagtacaactttttaaaaaactttttgagaaacaggattcagtaaacgagaaaataagagataattcgatatattatcagaaaataaatgtataaattgttaagaaatctaattatcagacaacttaagaaaattcatactttacaactagggaaaatttcggtatgataagaaaaaacacgagacagtacatcgagaaaggatgaatggatatgaaacagacaaatcaaattcctggattatatgatccaagttttgagcacgataactgcggtatcggtgcctgtgtaaatattaagggagttaagaatcatcagacagtagataatgcattgaagattgttgagacattagagcatcgtgcaggtaaagatgcagcaggagagacaggagatggtgtaggaatcatgcttcagatttctcataagttctttagcaaagcctgtaaggcagccaatatcaatattggaaaagaaagagaatatggaatcggaatgttcttcttcccgaatgatgaattgagacttcgtcaggcgaagaagatgtttgagatcatcgttgagaaggaaggaatgacattccttggatggagagaagttcctacaacaccaacagttcttggtaagaaagcactagaatgcatgccaaagatcttacagggatttgtagcaaaacctgcggatgttgaaaaaggacttgattttgatcgtaaattatatatcgcaagaaaagtatttgaacagagtaatgaagaatcatacgttgtttcattatccagcagaacgatcgtatataaaggtatgttcttagttggacagcttcgtacattttttaacgatcttcaggatttagattatgaatcagcgatcgcacttgtgcattcacgattcagtactaatacgacaccaagctgggagaaagctcatccatatcgttttatcgtacataatggagaaatcaataccatccgtggtaacgccgataagatgcttgccagagaagaaaatatggaatcagaatatcttaaaaatgagatgcacaagctgatcccagtcgtaaatccaaatggatctgactctgcgagacttgataatacattagagttcttagttatgagcggtatggatcttccgcatgcgatcatgatcacaatcccagaaccatgggaaaataataaagttatttctcaggaaaaacgtgatttctatcaatattatgcaacgatgatggaaccatgggatggaccagcatctatcattttcacagatggtgatcaggtaggagcagtacttgaccgtaatggacttcgtccatcaagatattacatcacagatgatgatcagctgatcctgtcttctgagatcggagttcttgacatcgacccaacaaagatcgtagtgaaagaaagacttcatccaggaaagatgttgttagttgatacgatcaaaggaaaagtgatcgcagatgatgtagtgaaagaaaaatacgcagagaaagagccatatggtgaatggctagacagtaatctgttagaattaaaagatttaaagattccaaatgaaccagttccaacatatggagcagaagaacgcgaaaaattgatgaaagcattcggatatacttatgaagatatccgtacagcaatccttccaatggcgttaaatggatctgaagcaatcgcagccatgggaaatgatacaccacttgcagtattatccaatcgtcatcagccattatttaattatttcaaacagttatttgcacaggtaacaaaccctccaattgatgcgatccgtgaggaacttgtaacatcaacaacagtttatgttggaaaagaaggtaatattttagacgagaaaccagagaactgccgcgtattaaaagtacacaatccaattcttacagatacagatctgttaaagatcaaatctatgaataaaaaaggatttgaggttgtagaacttcctattacatactacaagaatacatctcttgagaaagccttagatcgcttgtttgtagagacagacagagcatacagagatggagcgaatatcattatcctatctgatagaggagtcgatgaaaaccatgtggcaatcccttctttattagcagtatcagcaatgcatcagtatctgatcaagacaaagagacgtacatctgttgcactgatcttagagagcggggaaccaagagaagttcatcattttgcaacactgttaggatatggtgcatgtgcagtgaacccatatcttgcattacagggaattaagaaactgatcgatgaaaatatgcttcagaaagattattacgcagctgttgaagattatacaaatgcaatccttcatggaatcgttaagatcgcatctaagatgggtatttcaacattacagtcttatcagggatcacagatctttgaagcaattggtatcaattctgatgtgatcgaaaaatattttacaaatacagtcagtagagttgaaggtatttccttaaaagacttagaagcagatgtagatgcaagacatggagcagcgttcgatccattgggattagaaaatgatctgacgctggaaagtgcaggaagtcacaaatatagaagtggaaaagaacagcatctatacaatccacagacgatccatacacttcaggttgcaacaagaacaggaagttatgatctgtttaaacaatataccgatatgatcgataaggaattagaaccaggaaacttaagaggtttaatggaatttgattatccagaaaagggtattccaattgagaaagtagaaagcgttgactctatcgttaaacgtttcaagacaggagcgatgtcttacggatctatttctggagaagcacatgagacactggcaattgccatgaataaattaggtggtaaatcaaacagtggtgaaggtggagaaagacctgagagattaaaagtcggaagagatggattaaaccgttgttcagcgatcaaacaggttgcatctggacgattcggagtaacaagtgaatatttagtaagtgcaaaagagattcagatcaagatggcacagggagcaaaaccaggagaaggtggacatcttccaggtaagaaagtttatccatggattgcgaaaactcgtcattcaacagccggtgtaagcttaatttccccaccacctcatcatgatatttactctatcgaggacttggcacagttaatttatgattgtaagaatgcaaacagagatgcaagaatttctgtaaaacttgtatctgaagcaggagtcggaacagttgcatctggtgtagcgaaagccggagcacaggttattttgatttctggttatgatggtggtacaggagctgctcctaaaaactctatctacaatgcaggacttccttgggagcttggacttgcagaagcacatcagaatctgatcatgaatgatcttcgtaataaagttatcgttgagacagatggtaagttaatgagtggacgtgatgtggcgatcgcagcaatgcttggagcggaagaatttggctttgcaacagcaccacttgtaacacttggatgtgttatgatgagagtatgtaacttagatacatgcccagtcggagttgcaacacagaatccagaacttcgtaaaaaattcgcaggaaaacctgaatatgttataaacttcatgaagtttattgctcaggaattaagagaatacatggcgaaattaggagtagctacagttgatgaattagtcggacgtacagacttattaaaaccaaatgcaaaagcggctgaaaaacatgtagatctttcaaggattcttggatataaatatgatccagcacagaagatggattacaaccacaagaatgtatatgatttcaaactggagcagacagcagatatgaaagtgctgatgaaagaattaatgccagcactcgaaaagaaacagaagaagagtattcagcttgatgttacaaatattgaccgtactttcggaacgatctttggatcagagatcacaaagcactggggtgaacaggcattagaagatgacacatatgttgtaaaatgtaacggagctggtggacagagtttcggagccttcattccaaaaggtctgacattacagttagtcggagacagcaatgactacttcggaaagggactttctggcggtaaattaatcctttgccctccaacaggaatcaaattcaaagcagaagataacatcatcgtaggtaacgttgcattatacggagctacaagtggtaaagcatttatcaatggtgttgctggagaacgtttctgtgtcagaaactcaggagctacagcggtcgttgagggtgttggagatcacggatgtgaatatatgacaggtggtcgtgttcttgttcttggaccaacaggaaagaacttcgcagctggtatgagtggtggagttgcttatgtattagatgaagacagtaagttatataagaacttaaataaagaaatggtttcagtagaaactgtaacatccaaatatgacgttattgaattaaaagatatgttaaaagaacatgttgcatatacaaattctgaaaaaggaaaagaaattctaaaagactttgaacagtatctgcctaaatttaagaagattatgccaaatgattacaaagcaatgttaaatctgatcgttcagatggaagaacgtggattaagcagtgaacaggcaaagatggaagcatttaatatcaaggcaaatgcaggaaaataggaggaaattatgggaaaaccaactggatttttagattatgaaagagaagacgcccgtgcagaatctccgaaagaacgaatcaaacattttaacgaatttcatattcctctttcaagagaagaacagcagaaacagggtgcaagatgtatggactgtggagtaccattctgtcagtcaggaaaagtattattgaatggaatggcatctggttgcccacttaacaacttggtgccagagtggaatgacttgatctatacaggaaactgggaacaggcatacttaagacttaagaaaacaaatccatttccagagtttaccggacgtgtatgtccggcactctgtgagaatgcctgtacatgtggattaaatgggaatcctgtatgttccaaacaaaatgaattaagtatcatcgagtatggatacaaacatggattagctaaagccagaccaccaaaattccgtacaggaaagaaagttgcagtgatcggttctggaccttctggattatctgcagccaactctttaaacaaacgtggacatgaagttacagtgtacgaacgttctgaccgtcttggtggattgttaatgtatggaattccaaatatgaaattggaaaaacatatcgtagaacgtaagattgcgatcatgaaagaagaaggaattcactttgtgactaatgcaaacgttggaaaagatatcaaaccagaacagttaaagaaagattacgatgcagtagttttagcttgtggatcatcaaatccaagaaatatcgaagttcctggacgtgaagcaaaaggaatttattttgcggttgatttcttaaaatccacaacaaagagtctgttagattctggattaaaagataagaaatatatatctgctaaaggaaagaatgttattgttatcggtggtggagatacaggaaatgactgcgttggtacatccattcgtcatggagcgaagagtgttactcagctagagatgatgccaaaacttccagatgaacgtgcagagaacaatccatggccagaatggccaagaatctgtaaaacagattatggacaggaagaagcgatcgcggtttttggacatgatccacgtatctaccagacaacagtcaaagaattcaaaatgaataaaaaaggcgaagtcacaaaagctgttttagtaaatcttgaaagcaaaaaagatgaaaagacaggaagaatgatgatggttccagtggaaggatctgaaaaagagattccagcagatcttgtactgatagcagcaggattcttaggaagtgaagcttatgtcacagaagcttttggggttaaagttaaccagagaacaaatgtagaaacaaaaccagatagttttgcgacaaatgtagaaaatatctttactgcaggagatatgcatagaggacagtcacttgttgtatgggcgattcgtgaaggaagagatgcagctcgtgaagttgacaaacaattaatgggatatacaaatctttaagttataaaaattgaaaaatgatgtcagaaatacaaatatcgtctgacatcatttttcgtttgtaaaaaacaaaactatttttgataagttttcgagaaagtcttttcaaaagagattgtttttgctatgataatccgtggagaaaaaatcttaataaaagagagaagtatgagggagcagattggattatgcattttattggtcactttaaaacgattacaagacataagattctggtggcaaaaggctgttttaaactgggtctttattatcagggaattatgcacgatatgtccaaatattccccaacggaatttctggtaggagtgaaatattatcagggaacagaaagtccgaataatgcagaacgtatggaggaagggatttcaatgtcatggctgcatcataaaggacggaacaaacatcattttgaatattggattgattacagcattgataaagaccatccaggattggttgggatgaagattccaaagaaatatatggcagagatgtttgttgatcgtgtcagtgcaggaaagatttataatggagatgaattcgatcagaagagcccgttggaatattttgaacacggaattggagcatcgatcatgtgtgaagcatcgagagattatctgttaaacttgcttagaatgtatgcagaaaaaggtgaaaaatatacgtttgcctacttgaagaatgacttgaagaatgacatgagtggatatgataagatctcaccatttcaacaatgtaaaaaaaatattaagattggatagaatttcatgtatctgtgacttgaaatattaccatacttacagtataatatgtaatgtaaatcagataagaagcctggggtgtacgataacttgctattttgaacctacatttatttatcatgggacttcgtataatcgaccggatgtcaagccctgataccgggggacggcagaacgttgatcgagaaaacccacctagctctgctaggcgtcaaaatcgcgagaccggcattctgggtatatgatatgcaaaagataacaaaagggactgttagttttaacagtcccttttaacataacaaacctataaaggagttaaagttttgaaattttttaaagagaatgataaaacgccatttatcttagtggcgtttgggattatcttatatcttgtgttaagtaatcttccagttgtattttcaggaatatcttatgtaagctcagtggcatttccgtttattttaggaagttgtgttgcctttatcatcaatgttccaatgagtttctttgaaaggaaattgttttataagttaaaaaaaggaaagcgttcattgagccttattatggcaatcgttagtattgtgggtgtgatcttgttagtatcacgattgatcattccagaattggtagatacaatatttaagttatcaaacaatattcctgaatatgtaaaagagatacaagccctattagagaaaacatcaatgaataaaccaatggtacataaatatgtgaatcagatcacgtttgactgggataagatcagtggagagttgatcacatttttacaagacggcgcaacaagtatgctaaattcaacggtaagtgcgattacggatgttgtgcaatttattgtaagttttgcattgggatttgtatttgcactcaatgcattgcttcagaaagaaaaattatcaatgcaggtgaaaaaggtattggtcgcttttttaccggaacgggttgcgaagtatattgtacgagttggaagactatcaaataatgcattttcaagctttttatcagggcagtgcttagaagctgtgattttaggctgtctgatttttgcatcaatgaaactattaggacttccatatgcggtactgatcgcagtttttatcggtgtgatgtcattaattccgatcattggcggctttattggatgctgggtcggggtattattgatctttatggtagattggaaacaggctatcatttttatcatcatgttcgttgttgtacaacaatttgaaggaaatgttatctatccacatgttgtaggaaactctgtaggacttccggcaatatgggtgttagtagctgtaacgatcggtggaaatatcgctgggatcgtaggaatgatttttagtattccgttttgttctgtcttatatcagctgttttctgagattgtgaacaaacagataaagaaaaagaatgtggatataccttgatgaaaatgcacataatacttctataaaataaaaatggaggtatttgttatgaatcgagatcagatcatctgtccatgccttgatatcacagcagggcagattatggatgcatacaaagaaggagcgaagagtgtcgaagcgatcaaagaggtaacgggagcaggaacagcttgcggagcttgcttggatgaaattgaagaattaatacagagtttgtaattataaagagatgttgttcgatgtttttgagcagcatcttatttattgtataggggattttgttgaaatttcctatgcaataaaaaaagaaccccttctcagagattctcatcaaatgccgatggtgggactcgaacccacacgtccataagaacaacagattttgagtctgtctcgtctgccagttccgacacatcggctgattcaattgttcgacctaaaatatattatcacttttgaatcataatgtcaataatttttataaaaattatgaaaattaaattttaatccaattttaaaaaggcaaaaggatcggagggatcactttggataaaatgtaataagagataataagctttcacagaaagattttcttctcttaaaatacgttttgcttcatttttatcaactaactctaccgataaatcttcattgggctctaaatgatcaagattcggcattccagtagaaattccataaaccgtgcaattggtctcatctgtcattccagcagaagagaaatgaggacgacttaagaaatcatcaaattcagcgggtgtaaacgtaagacctgtttcttctttcatttcacggattgcagtttctttgatagattctccgggatcgatcaatccggcaggtaattcatatatataatcatttaaaggataacgaaattgtcttaccatgatcagatgatcagctttttctccaaacagactataaatgacaacgccatcaggaatgacttctttcgtggcagccatcattatattttcattcttgcgactggcaacataatatggatgtgtatctccaaatttattttcagcttctaattcataaagattcagaaattttacatttgttagtggtgtgattttatttatcttactcatagatattacctccctgtatatttttattgtaaagcatcacaacaagattgacaatagacataaaaacaagtattatatactaaaacgatatgaaataaggggattacaagaaaggagttatgatgagaaagaaaattatggctacaatacttggtacagcgatacttttaacagcagtttcttttacaggttgtggaaaatcagtcaaggattctacaagtgcgaagacggagaaaaccacaaaagaaacaaaaagagatgagaagatcgaaataaaaatactttcaaaatatgatcagataaaaaaactgctttcaaaatatccgaaagaaatgacggcagaagatacatcatatcagggaattgtggtaattgaatatgattcatttggcaaaggaagcaaaaagctttggaatcagtttttaaagaatgtaaaagatcataaagattgtgctatcgtaatttgtcagtataccgtagagggagatccgattcttcagtatgtttctaatgtaaatgggaagttttactatgtagaggattctacgagagatgcttatggcagtgaaaaatacgtacagtatacttatgactactacaagatttataaacaggatggccattacacagcaattctgacaatggataacaaactgacatttgatgaggcacaggatgtcagaagcttaaagacagcgatacagttactggatgttaaacaataattaagaaaatggagcagagaatatgaaaatttcaacaaagggaagatatgcagtccgtttaatgtatgatcttgcaatgcatcatacaggcgattggatcgcattaaaagacatatcaagaagacaggagatatctgtaaaatatttggaacagatcgtaagacagttaagtatcaggggatatttaaagagtttgcgaggacctaaaggaggttatcagctttccagagacccaaaagattatacgatctatgaaatcttaaagataacagagggaagcttacagccagtagcgtgtttggatgataaggtgaatcagtgtgaacgctaccatgaatgtccaacgatagagatctgggaaggattaggacaggtaattgaagaatatttaagtggaattacattagaagatgtcgtaaataaagcaagaatcaaaggtggaaacgattatgtgatctaaggatcacatggtcgtttttcttttattaaaaatatgatgagagtgtcaaaaggaatgcgaaagataaaagagtttgacattgttttaaaatctgatatactaataacatattaaaaagataggaattatatgaaaataaaatcaaaggagtaaaaataatgtcaaatatatataaaaatgttatagaattaatcggaaaaacaccgcttgtagaagttgaaaatgtagaaaaaagatttaaactacaggcaagattattagtaaaactagatggatataatccagcaggaagcgcaaaagaccgtatcgcatatcagatgatcgttgatgcagaagaaacaggaaaattaaaagaagggtctgttattatagaaccaacatcaggaaatacagggataggacttgcagcgatcggtgcatccaaaggatacagggtaatcctcacaatgccagagacaatgagtgttgaacgaagaaatctattaaaagcttatggagcggaaattgtattaacagatggttcacaaggtatgaaaggagcaatcacaaaagctgaagaacttgctgaagaaatcgaagatgcatttatcgcaggacagtttgttaatccatccaatccgaaagttcacagactgacaacagggccagagatttggaaagacacggacggagaagtagatatttttattgcaggagttggaacaggaggaactgttacaggagttggagaatatttaaaatccaagaaagaagatgtgaaagtgatcgctgttgaaccagcaacatctccaatgctttcaaaaggtcaggcaggaccacataagattcaaggaatcggagccggatttgtgcctgaagtgttaaatacagaaatttatgatgagatcattcgagtggagaatgaggacgcttttgattatggaaaagtgatcgcaatagaagaaggaatcttagttggaatttcatcaggtgctgcattatatgcggcgattcaggtggcaaaacgtaaggaaaataaagggaagacaattgtagcatttttgccagataatggagatcgatatttgtcaacaccattgttttcataaatgcatgttaaatgttattggttttcaatttctgtagttttgtgttacaatgtctcagaacgcatttatagaaaaggagaacaatctggagtgaaacagaaattattattgattgatggaaacagcattttaaaccgtgcattttatggattgcccgacatgaccaatagtcaaggactccatacgaatgcgatccttggttttttgaatattatgtttaaatttttagaggaagagaatccgacacatctggcagttgcatttgatttaaaagcgccaacattccgccataaaatgtttgcggattataaaggaacgagaaaaggaatgccagatgaattacaagaacaggttccagtgatccgtgaagtgttaaaggcaatgaacattcctttgatgatggaagaaggttatgaagcagatgaccttcttgggacaatgtctgttcttggagaacaagcaggatttgaagtgaaaattgtctctggagatagagatcttttacagcttgcgacaaagaaagtgcagattcgtattccaaagacaaacagggctggaacggttgttgaagattattatgaagatgatgtgttagaaaaatatcaggtaacgccaaaggaatttattgacgtgaaagctttgatgggtgatgcatcggataatatccctggaattcctggaataggggagaagacagcgacaaaactgatcaaagaatttcaatcaattgaaaatgcatatgcacatattgatgaagtaaaacccaatcgtgcaaaaaacaatctgcaggaatactatgatcagggtgttatgagtaaagaacttgcaacgatcaaggtagatagtccgatcgatatttcgtttgatgatgcgaagcttggtgatctgtatacgaaagaagcgtatcatatgttgaaagaattggaatttaaagcaattctcaaacgttttgatggagaagaacaagaggatttcgaaattaagatcaaagaaatcatcgatcttgcagaggcggaagatatttttgcaaaagcagtgaagaagaaagaagcaggaatctccatttataaagaaaatgatgcaatgtgggttgcattaaatacagaaggagaagaagtatatttatttagttgtgaaggttttggatttataacgcaagattttttatatgagaaaattgatgatctatatgacaacataggatatgtggcaatgatggaagtgaaagaacatttgtctcatttaacgatccatgagacgacaaagagtatttttgatgtttcactggctgcttatcttgtgaatccattaaaaagcacttatgaatatgatgatattgcaagagattataaatctatgatgcttccatccagaaaagaattgatcgataagaaacatccaatggttacagatggggttttaagtgatgcaggaaagaagatcatgggttatgaagcttatatttcaagagaagcgatccaaccattaagtgataaattaacggaacttgagatgatggatctttatcgagagattgagattccaacaatgtttgcacttcatgatatggaagtacgaggaattcacgtagattcgaaagcgttgaaagaatatggagatcagctggttggaaggattgaagaattacaggagtctatctacaaagaagcaggggaagagttcaatatcaattctccaaaacagttaggtgttgttttatttgaacatatgaaattagaaggtgcaaaaaagacaaagactggatattccaccagtgtggaagtgttagaaaagatcgagcatctctatccgatcatttcgatggtcttagaatacagacagttgacgaaattaaaatcaacgtatgcagatggattagcaaattttattcaggatgatcagagaattcatgggaaattcaatcagacgatcacagcaacagggagaatcagtagcacggaaccaaatcttcagaatattccaatccgtatggaacttggaagagcgatccgcaaagtatttctgccagaagatggatatgtattcttagatgcggattattcacagatcgaacttcgagttctggcacatttgtcacaggatgagaaactgatccatgcatatgaggagaatcaggacattcatgcaagaacagcttctgaggtatttggaattccgatggatgaagtgacgagtacacaaagaagagatgcaaaagcggttaactttgggatcatttatggattaagtgcgtttggtttaagtcaggatcttaagatttcaagaaaacaggcacaggaatatattgatcgttattttgcaatgtatccacgagttaaggaattcttagatggggaagtggaaaaaggaaaaacagacggatatgtaaagacaatgttcaatcgaatccgcccaatcccagaattaaaatctagcaatttcatgcagagaaactttggagaacgtgtagcaatgaattccccgattcagggaacagcagcagatatcattaagatcgcaatggtaagagtgaatatgaaattaaaagaaaaacagatgaaatcccgtctgcttttacaaattcacgatgaactactgattgaaacacatttggatgaatttgaggaagtcaaagaaatcttacagaatgaaatgatgaatgcagtaagccttcgtgtgccattaaatattgatattgaacagggagcaagctggtacgaagcaaaataaggagaagataaatgaaaatcataggaatcaccgggggagtcggctctggaaaaagtgagattttaaatatactaaaaaatgattatcaggcaaaagtcattcaatctgatcatgtagcacatgagctgatggtaccaggggcaaaaagttatgatgcgatcgttcaggcatttggaaatgaaattttaaatgaagaccagacgatcaatcgtccgatacttggagagatcgtgtttcatgatgaaacaaaactttcattattaaacagcatcactcataaaaatgtagatgaagagattttatcaagaattgatcagtttggaaaagaagaaccagaaggtttgcttgtcatagagtcagctttgttagttggagcaggatatgaaaagagatttgatcagttatggtatatttacacgagagaagaagtaagatatgaacgcttaaaagcttccagaggatattctgatgaaaagatcaaacagatgatcgaaaaacagcaaaaagaagaagagtttaaatctatggcaagcaatatcattgataattcaggtgatctagaagatacaaaagcacagatcataaagattcttggttgatattttgtacatttaagaatacagtgcaattcttgaatcttaaataaccttatgatataatgtttgccaatagggtcagcccagaagagaagaaagaggtataatctgtgaaactatcaagtttagcaagcagcagtgaaggaaattgcatatatgttggaacgaagaagacgaatgtattagttgattgtggagtcagtgcaaagcgtattgaaaattcactttcagaacttgatcttaccgttccagaatttgatggaattttgatcacacatgagcatacggatcatatcaagggacttggtgttatcgcaagacgatatggacttccaatctttgcaacaggaaagacgatcgatgcgatttttgattataagaaccttgggaaagttgataaaagcctttttcattcgattgaagcagacaaaccatttgagatcggagatatgaaagtcaatgcatctcatatatggcatgatgctgcagatcctgtttgttactcgttttactcagaagaaggggccaaggcaagcattgcaacagatcttggagactacgatgaatatctggtagagaagatatatgattcggatattttatttgtagaagctaatcatgatgtgaatatgcttcaggttggacgttatccgtattatttgaagagacggatccttggaagagagggacatttatcgaatgaaagatgtgctgaactgattgaggaagttgcaacacagaagacaaagaaagtttatcttggacatctgagtaaagagaataattacgaaaaactggcatacgagacggtaaagatttctttacataattttacattaccgatcgaagtagccagaagagacacggtatctaccgtaaccagtgtatcataaacatttaggaggaataacaaaaatggaaaaaacagtaatcacagttgttggaaaagacggtgtaggaatcatcgcaaaggtgtgtaactatttagctagcaacaatgttaacatcttagacatctcccaaacgatcacaggcggcttctttaacatgatgatggtcgtagatccagctggttcatccaaagatatcgcattattatccagtgagttaaaacagatcggtgaagaaatcggtgttgtaattcaggcgcagaacgaaagaatctttgatattatgcacagaatttagtggggtggcatcatgattaatctgaatgaagtatttgaaacgaataaaatgatccatgagatgaatttagatgttcgtacgatcacgatcggtatcagtttattagattgtgttggtgcaacgctagaagaggtcaaggagaatatttataataagatcacaacagttgcaaaagatcttgtgaagacaggaaaagatatcgagaatgaatttggtattccaatcgttaacaagcgaatttctatcacaccaatttctttagtgggtgggaatgtatgtaagacaccagatgatttcgtagaacttgcgaaagtattagatgcagcagcaaagaaagttggagtcaacttcttaggtggatattctgcattagtaagcaaaggaatgacaaaagcagatgaattattgatccgttctattccaaaagcattagcagagacagactttgtatgttcctctgttaatgtaggttctacaaagacaggaatcaacatggatgcagtgaaattgatcggtgagatcatcaaagaaacagcagaacttacaaaagacaaccagtgtcttggatgtgcgaagttcgtagtattttgtaatgcaccagatgataacccatttatggcaggagctttccatggagttacagaagcagatgcgatcatcaatgtaggtgttagtggaccaggtgttgtaaaacgtgcgattgaaaatgttagaggagagaactttgaagttctttgcgagacgattaagaaaacagcgtttaaagtaactcgtgtcggacagttagtagcgaaagaagcatctaagagacttggaattccatttggaatcattgatctttctcttgcaccaacaccagcagcaggagacagtgttggagagatcttagaagagattggattagagtatgcaggagcaccaggaacaacagcagccttagcgatgttaaatgaccaagtgaagaagggtggagttatggcttcctcttacgttggtggattaagtggagcatttattccagtcagcgaagatcagagaatgatcgatgcagtgaatgctggagctctgacaattgagaaattagaagcaatgacatgtgtatgttctgtaggacttgatatgatcgcaattccaggaaaaacaaaagcaacaacgatcgcaggactgatcgcagatgagatggcacttggtatgatcaatcagaagacaactgctgtccgtgtgatcccagcaatcggaaaagatgttggagatcaggtagaatttggtggattacttggatatgcaccaattatgccagtgaatgaattttcatgcgatgcatttgtgaatcgtggaggaagaattccagcaccgatccatagctttaaaaactagaaatcaagatatttttgaggtgacaattttggggtattagatcagcatgcagacattatatcatcagaatcagatatggtggacatgcatacaggaagagaacgaatgtccggatcatctgttaagagaacttgggagcggctgcataagattatagaggaattcccataagttcaaaggaacggcataggccgtggactatattatataaacacaaattaagaagagaatttaaaaggagatatataaaatgagtcaaaacgtatatgatgtgctgcaagaaagaggatttatcgcacagacaacacacgaggaattaagagaactgttaggaaaagaaaaagtaacattctatatcggatttgatgcaacagcagacagtttaacagcaggacattttttaacgatcatggcaatgatgcatatgcagaaagcaggacatcgtccaattgctcttttaggtggtgggacaactatgattggagatccatctggaaaatctgatatgagaaatatgttaacaaaggaaacgatcgatcataatgcgaaacgtttcaaagaacagttgtcaagatttatcacatttgatgatgacaaagcaatcttagcaaataacgcagattggttattaaatttaaattacgttgaattcttacgtgaagttggagttcatttctcagtcaacaagatgttaacagcagaatgttacaaacagagaatggaacgtggacttacattcttcgagtttaactatatgttaatgcagggatatgatttccttgagttaaatagaagatatggatgtaaattagagatgggtggaaacgaccagtggtctaatatccttgcaggagctgacttgatccgcagaaaagaaaagaaagatgcttacggattaacattaacacttcttacaagaagcgacggagtgaagatgggtaaaacaatggcaggtgctgtatggcttgatccagagaagacatctccatacgatttctaccagtactggagaaatatcgaagatgtgaaagtagaagaatgcttatcacttcttacattccttccaatggatgaagtccgaagactgggagccttagaaggagcagagatcaacaaagcaaaagaagttcttgcttatgaagttacaaagatcgttcatggagaagaagaagcgaagaaagctcagacagctgcaaaagcaatgtttgttagcggtggagcaaacgaagatgcccctacatttgaatatgaagcagataaattagcagaaggaatcgatattcttacaatgttagtagattctaaactttgcacaactcgttcagatgcaagaagaatggtacagcagggtggagtttctgtaaatggtaagaaagtagatgcaattgatgcaacatttggtaaagctgattttgatgataaagatcgtatcttattaaagaaaggtaagaagaaattctgccagatcaaagaaaaataattaaaaaataaacaagtaggaatcccggagagttgatactccggggttcttttcaatattcaaaaggaaaataaaaaagatatattagaaagagaatcagaaaaagaaaagaggaagagaactttgaaaacaaaatgcacaagaggaatcatatattttatcggtttgatcgtgcttgcacttggaattgtattaaatacaaaaacattgttaggagtatcaccgattatatctattccatataatatctgtcatatctggcatttaaacctaggagcaataacctttgtgttttactgcttttgtgtgttgatagaggcaatcttaaaaggaaaagaatttaaattatatgaattattacagattccaatgagtcttgtgacaagtgtatttatcaatatttttgaccagtatttaaatattgtaccagatacattggaacagaaacttctagtattattttttgcgatcgttgttacgggaatcggtgcagcaacgatggttaatatgaagcttgtacccaatcctgcagatgcacttgcagcgacaatcggagataaacttggcaaaggcatggggattggcaaaaatgtttttgatgttacttgtttttgtacgtcaggaatcattggacttgtatttacaagacatatcataggacttggaattggaactgtactggcagttatttttacaggaagagtcattgcagtttataattatttcctaaaacatccaatgcagaatcttgcaggaatcactacagaattataagccagagataatgaaagcccttcatgttacaaaaaatatgtagaaaattgtcgaaatttatgatgtctggattgtttggagcgtgtctgtttatggatggaatgccgatcagacgaaaaggcttatatggttttgtaatctttctgatcgtttgtatggcaggtgttttttggcttacggatggtaaattagaagctgtagagcaggcaagaaaggatatggtgcattgcattcatgaattaagatatggaaaagatcagattccagaagaattcagatgaaatgatgcgtgtaatatcagaacagaaaaaatcattatatttaaaagcatacgtaggttccgtatataaagatggagtctggaggaaaatgccagagggacaagatccattgcaatggtttttgacaacttcccgtacaggaaatcagatgttatatgcatcagcagcagtggaagctttccgtgcacatggaattccagcaagatacgtggaaggatactatcttggagcatccaaaatccaagacagcaaaaatggagaggtatctattacaggggagaatgctcatgcatgggtggaagtttattttgacggagttggatggaaggcagtggacgtaactccgggatattactataatgtggcaacacttcagaagatggtaaacacaccagaacagattaagaagaatgcagcaatgattttgttaggtgcggtaacagtgctcgtaattgcaggctttaatttgttcgtgatcttagaaatccgtttatggctcttagaacagactcttaagaaacaatatgaacaggcagatatggattagaagattagaatcttacagatgcagatttttggattgttaggaatctttggaattgaaacaaaatttggatggaaaacaaaagaaaagttaaaactgaggtatcaatttcaaaaatattgtatgtaatttaagctaaattttggaatagtccaatgccaaacaaaaagaacgacgaactcttgcagccagttcattttgctctaaaatatcttctatcaagaacgcaacgccatcctgatcattagaaggagcaatgacagaacatatatctttcacggcagcagaagcatttgccatagcagcagtgactccaagatcaagagataacatagaaagatcattcccactatcaccaaccgcgaggatttgtgaaggagtgatcttttttgtttgggcataacgaagtagagctgttcctttctgtgcatttacatacgtgatctccagatcatttttggaagttgataccgcatgtaactgatcaatcccatgaatatcatcttttaaagcattgatcttatcttgatcaaaaaatgtagtagagattttataaattggtgtttcacagccaagcagactttcttttccttcaaaaaagcgaactttagaaaccatcattgcaaagtcgtgccaagtacggaaatatactttaccttcttgttcaacggcaggaaacacttcatttttataataagataataacgtatttttatcagtgattgaggtttttccatattccgttgcaatgtcggcaaaagcaccatgccgttcaaaaacagttaagatttgttttgcaatacttttcggaagcgaagcaatatgaaatccattgccatgcacatcataagtacaagccccactgtgacagatcatatcacaggaaagagatgccgcattaagttctcttttggcagcgcgataatcccttccagtatttacaataaagtgaattccatgtttctgtaattttttcaccgcattgatcgttcggtcagatatatatcctttgtcatttaataaagttccatccatatcggatgcaaataatcgtatcatgttaagtactcctttcgtgtgtataagatgatggtaacagggaaatacaaaatttaaatgatatctatgttaaatttctgcaatgaaaactatttagaaaaatatctaaatagtaattgacttttggaatacatcatgctataaagtaattagaaatatttctaaatagtcacagaaaggatgagagttatgggatttgcagagacatttaaagcattatcagacccgatacgaagagagattcttatgatgttgcgggatggtagtatgtccgctggagagattggttctcactttggtatgacaggtgcaaccatttcttatcatttgaagattcttaaaaaagcagagctgatcttcgagaagaaagagaaaaattatatttactacacgttaaatacatcagttgttgaggaagttatgttatggttgtcagaattgaagggaggaaatcatgatgttaaagaagaataagaagttttttattgcaagttgtattgtaattttattaccaatgtttgctggattcttattatgggatcagttgccagcacaggtggcaacacattttggaagaaacggcgaggccgatcgatacagcagcaaattatttgcagtagcaggaatttatctgtttttactggcagtgcatattttatgtagtgttatcacagaatttgatcctaagaaaaggaatgttgggtctaagatttatcatctgatcctatgtatctgtccggttgtatcactttggtgtggggtaatgatctatggaaatgcattaggatataaagacgtgatcaatttaaatctgtggacgaatgttttactaggaatagttctgatcgttgttggaaactatcttccaaagtgcagacagaactatatgattggaatcaaacttccatggacattggataatgaagaaaactgggattacacacatcgaatggcgggaaaatggtggatcatcggtggagttttgacgattctgcttggatttcagaagtttgttgatccaattggagcaacagtagggattattttgatcgttacattgattcctgcgattgcttcttatatttattataagaagcatagagttatgtaaaaaagcattgtggtagataaaaaagaaatcagatgttataataaagttaattatcggacagaagggagtgatcacatgcaacaagtaatatctgtagggaatcaggattttaaatcaatcagagaaagagcaggcaaagtaattcggatattaaagttatcatggaaaatttgctttatggaaagcagatagaagaaaaacattatgatgcacaattgcttgcaaaaggaatgaaaaaagaaaagatcagatattatggttttgccttttgtggaaagaaagtactgatcggaaaataagaaaagatgtcataatagaatatggcatcttttcttttacacaaaaaagaagtttcaaatgaagataaaaataattatgaaccaaatctattgacatacaaacaaaaaaatgctaacttataattacaaacaaaacaaaaataagttacgaacgaaacattctgaaaggagataccatgaacaacacagaacatttcggtaaattaacagaacgcatgcaggcatttcgtgaggaagtgctcgatgcaaaaccatatattgacgcacagagagccgtactggcaacagaagcttataaagaaaaccagaatcagccaagagttatggtaagagctttaatgctacagaagatcttagaaggaatgagcatttacattgatgacaaatccctgatcgcaggaaatcaggcaacaaagaacaagaatgctccaatcttcccggaatataccatggaatttgtgatgaacgaattagatctctttgagaaacgtgatggagatgttttctatattacagaagagacaaaagaacagttaagagagattgcaccgttctgggagaataacaatcttcgtgccagaggagaagctttacttccagaagaggtagatgtctttatggagacaggtgtctttggaatggaaggaaaattaaatgctggagatgcccatctggcagtgaattaccagagaatcttatctgatggattgaaaggatatgaaaaaagagtaaaagaattaagagcagcattagatttcacagatccagaaagcattgataagaacgtattttataaagcagtcttaacagtcattgaagccgttcgtgattttgcacagcgttacagcaaacttgcaaaagaattagcagacaaagaaactgatgcaaaacgcaaagaagaattattacagatgagcaagatctgtgccaaggttccatatgagccagcaaattcctttagggaagctgtacagtctgtttggtttatccagttgatccttcagatcgaatctaacggacattccttaagttatggacgttttgaccagtatatgtatccatattatatgaaagatatcaatgaaggaaagatcacaaaagaagatgcattagaattattaacatgtctttggatcaagacattaacgatcaataaagtacgttcccagtcacatacattaagttccgcaggatcaccaatgtaccaaaacgtaacgatcggtggacagacaactgataagaaagatgctgtcaatgaattaagttttgtagtattacaatctgttgcacagacaagactgacacagccaaacttgacagtccgttatcatgccaatatcgacaaacatttctttgatgaatgtatcgaagttatgaaactcggatttggtatgccagcattaaataacgatgagatcatcattccatcttttatcaattggggtgtcaaagaagaagatgcatacaattatagtgcgatcggatgtgtagagacagctgttccaggtaaatggggatatcgttgtactggtatgtcttatattaacttcccaagagttctgctttgtgcgatgaacgatggagttgacttaacaagcggtaagagatttaccaaaggatatggtaaatttacagagatggaaacatatgaagatctcttagcagcatgggataagaccgtcagagaaatgacacgttatagtgttattgtggaaaatgcaattgataaagcatctgagcgagatgtaccagacgttttatgttctgcattaacagatgactgtattggaagaggaaaaacgatcaaagaaggtggagcagtctatgactttatctctggacttcaggttggtattgctaatatggcagactctcttgcagcgatcaagaaacttgtatacgaagagaagaagatcacaaaagaacagctttggaatgcaatcttagacgatttccaatcagaagagaacaagaagattcaggaaatgctcattaatgacgttccaaaatacggaaatgatgatgactatgtcgatcagttagtcgtagaagcatacgattcttacttagatgagattaagaaatatccaaacacacgttaccacagaggaccgatcggcggtattcgttatggtggaacatcatctatcagtgcgaatgttggacagggaatgggaaccattgcgactccagatggaagaaatgcatttgaaccattagccgaaggaagcagtccggcacataatgcagataagaatggtccaacagcagtatttaagacggttgcgaaacttccaacagagaagatcacaggtggagttttattaaaccagaagatgacaccacagatgttatcaacagaagaaaacaaacagaaattagagatgttgatccgtacattcttcaaccgtttacatggatatcatgtacagtataatattgtatccagagaaactctgatcgatgcccagaaacatccagagaaacataaagacctgatcgttcgtgtggcaggatacagtgcattctttaatgtattatctaagaagacacaggatgatattattggaagaacagagcagacattataatttacaaaaatagaggaatggcagttggcttgagtagggttaactgctgtttttcgtgatagactagaagaaataatattcatgaaagaaacaattaaaaaagccttggcaagaaactgttctgccaaagctttttgtgtatatggaattttcaaaaggttagaaaaagcaatcgatacctacatctaaaaagatccgctgataatcggtaagatcctcaggatgcaatgctttcacattctcataagaataagtctttccgagtaaatgatacttgttttctccgaattgatggaaaggaagcagttgaaccttcttcgctccaacctgatttaataaagtagcgattccttttgcatcatccaaagaatcattgaaatcaggaatcacagggattcgaggaagaacttcaattccttgagagatcgcccatgctaaattctcaatgatcagttcgttatggacatgggttccttcataatgcttatcactgtcatagtgctttacgtcaaacaaaagcaagtcaaacatcggagccaattctctaaaaatctctttcttgatatatccagttgtctcaatcgcagtatgaatcttatgttcttttaattttgcaagtaaagcctttacaaaatctggttgaaccattccttcaccgccagagattgttacaccgcctccagattcctcataaaaatcaatatcctgaagacagactttgacaacttcatctacatcttttgcttctccttcataacttaaggcctttgcaggacagttttttacacattgaagacatccagcgcattttgatggatcaatacctacataactgtcatctcccatagaaattgcctggtttggacagacatgcgtgcaagtaccgcaatgagcacatttttctttatcatataaaatttggacttggctcaactgtgattccggatttgcacaccatttacaacgcagtggacagccttttaggaaaactgttgtacggattcctggtccatcgtgaatgctgaatttctgtatattaaaaacaataccatttgtttgcatggataatatttctcctttctgattcttttgtatatcttatcacacaacttacgaaaagtaaataatatacttacaaatgaaagttaaaaaacattaaacgaaaataattgttgacatattcgaaaattatggtaagatagaagtatcaaaaaacgaaacacgtaataagacttaggaggagttttaatcatggaatttatcttagatacagtagatcttgaagagatcaaagacggtgtagaccacatgccaatcgttggagtaacaagcaacccatccatcgttaagaaaacatcaccagaagatttctttggacatatgagaaaggttcgtgagatcatcgggaaagaaagaagccttcatgtacaggtaatttcattagatgcagaaacaatcgttaaggaagcccacagaatcttagaagagatcgatgatcaggtatatattaaagttcctgtatcctatgaaggattaaaagcgattaagatcttgaaatcagaaggtgttaacgtaacagcaacagcagtttatgatctaatgcaggcatattttgcattagcagcaggagctaactatatcgcaccatatgtaaatcgtatcggaaatctcggggcagaccctatggaactgatcagcaatcttcaggaccgtatcgaagatgatggatatgattgtaagatcgttgcagcatcatttaaaggcgttgaacaggtgaagaacgcatttaactatggagcagaagcaatcacagcaccatatgcagtattaaaacaggtatttgcaaatcctaatattgacaaagcagtgacagacttcaacaatgactggtatgcagtttatggagaaggtaaaggaatctgtgacctttaattaaaaatatgctattatatgaatagtgcagagggataaagagccgcaagacggctctttcctaatattatgaagaaagggaaagtttcatgacagacagacaaacaaagattcttgaaatcgtaaatcaaaaaaagaaagtagaagtggtaactttgtcacagatgctggaggtatcacaggtcacgatcagaaaagatcttgatgctttggaagaactgaattttctgacaagagagcatggatatgcgacaatgaagaatatgtcagacatcagcaatcgtatggctttttgttatgaaacaaagcagcgtatcgcagaaaaagcaagtgagatcatatctgatggggaaacgatcatggtagagtcggggtcaagttgtgcattgcttgtaaaatacctttcagagactaagaaagatattacagttatcacgaattcatcctatattgcccgatttatcagagaaacagagggcggtgttacaaaggtcatcgttcttggaggagaatatcagaaggaagcagaagttatggtgggaccattggtgaaaacttgtgcagaagctttttatgtagataaactatttatgggaacggatgggtatatccctggcatcggattcacaagcggagatatgttaagggccgaagctgccaagagtatggcggattctgcaaggaattctatcattttaacagattccagcaagttttcagaacatggagttgtcatgcagtgtagactcaaagatattaatatggtatttacggacgatcaagtgccattagaagctaaagaagcgatggaacaaaatgggattatcgtagaaacagtacctagataaggaagaaatgataatagaaactgtcatatgaatggaagaaaaattcgtatggcagttttcgttttcacagtaaaaacactgctgttaatatgtacaaaaataaatacataagatataataaagttgtaatttaataattaaaacaaaaggaggcagtggatgagaacaagaaagatgatgttgtatgcgggtatgatcgcatctctgacaatggggatttttataagcggagcaggtcagcagaaagtggaagcgaaaactaaagtaacatacacgcttaagaagggaacattgacgatcaaaggaaaaggtgcaatgcctgcgaagatgaaatttcgaaggaacaagaagatcaagaaagttatcattaaaaaaggcgtgacatctgtttcatatgaagcgtttgcattatgtaagaatttaaattctgtgacaattccatcaacagtaaaaacgataggaattcgaagcttctatggaacaaagatttctaaaataacggttccatcaaagacaaagacgatcgggcagggggcatttggaagttgtaaaagtttaaagacgatcgttatgccaggagactttaaattaaaactcgaagaggatactgacgataagttatggtatgtcacaagtgatcagtcagcagttgataccataacatttaatacaaaattaaaattggcaaatgtatcatatctgtcagcaaataatctggtagttgcaaagaatgatccatcatatcagagtatcgagggtgtaatctatacaaaagatggaaaaggaattgtaagagtacctcaaaagagaacagagcttaagatcaaagaaggatgtacagagtttaatatgcaatcggtattatataattccacagattctgaaggagatgagttcaacaattgttctaaattaaagaagattgtaattccatcatctgtaaagagtattaataaagtaaaatataaaacggatcgagcggatgcgtgtgatatgcacgttgataccattgaaattgctccaaaagattttgatgcgaacagcctttacgcattaggaagttctcttgggaagaatatcacgattgaatcattaatgaaattacttccagatcagattacatacaaagatcatatgtatattacaaaagatcacggtttattaaaatatgacggaaaagatgcaaatgttgaaattccagaagagatcacatggatcgcaccagaagcattttatagaaatgaaacattaaagaatgtcaaacttccatctaagatcactacgatcgaagaaaatacattttatggatgtagtgaattggaagccgtagtaattccagatcaggtaaccatgatcggcaagtcagcatttgatgaatgtacggtattaaaatccgtaacatttggaaaatccttaaaagtgatcaaagatcatgcgtttgcttcagtaaatatcagaaactttacaatcccatcaggaattcaaaagatagagacaggtgcttttgctggaatcaatcagattgggacggttacatttgagggaagtacaaagtatgttgcagcagatgcatttatgaattccacaggaatcaaacttgtatataagaaagggatcaaggaagcgcaaacagaattatcttatgactatattatagccagaaagaatggaaataataaagttcgtacaacgtggcagccagtatcaggagccaatggttatcagttaaaattcagtactgacaagaaatttaaaaaagtattgaaaacagtaatggttaagaaaaatgtgtcaaatgctacaacatatgtaaagaataagaagaaaaccctctatattaaagttcgtccatatcagacacttaataagaagaacgtttacggaagatggtcttatctgcagttatagtaagaaaaatgaaaagaagtatttaaacaaagaagcgctagattggtattttgccaaaactagcgtttctttttgtgaagattatctatgcatgatgagaaatttaaatcaaattgatttagaatatgctcactgtaggaatcggtctggttgatgtgggaaaaagcagattgaatttttttgaattctttggcagaagcagtcttaaagcatgcgattaaaaagaataaaaacaaaatagaaaagccaattcttaattttaaaaaagaccagtatgttggtgattggttttcttgctcatttatataggaagaaaaatcattaccagaatttaattttcgatatgtatcattaagtcgagtttgttctatatgaaaatccgtatttttatgcatgaaaagtacctccttttgtacattctattcagagaagaaaaaaactgaacaaattttcaaaaaaattgaaagaaaaggttgacattaaaatgcgaaagtgctactttaaatatagatgttagcactcgatataaatgagtgctaataacaggaggcgaagatatggagttaaatgatcgtaagaagttaatattgaaagcgattatcgccaattaccttgaaactggtgagccggtaggatcaagaaccattgccaaacatcctgagttgaatttaagctcagcaacgatccgtaatgagatggcagatctggaagatatgggatatatcttacagcctcatacatccgcaggaagaattccttccgacacaggttatcgtttttatgtagatcagctgatgacggaacgtgacagcgaacacgaagagaaacaggcattgattcagagagttgataagatggaagtcttattaaaacaggttgccaatgcattggcaaacagcacgaattatgcaacgatggtttcttccccacattatcagaatgtaacactgaaatttgtgcagctgtctcaggtggatcacgaacatctgcttgcagtgatcgttacacaaggcaatatcgtaaagaacaagatgatccaggtagaagaaccgctttcgaatgaagatgttctgaaattgaatgtattgttgaatacatttttacaaggattatcattacaagatatcaaccttgcactgatccagacgatgagagagcaggcagggatcagacaggatgtgttagaacggattcttgaagagattgccaaagcgatccatgatgcagatcatatggaaatctacacaggaggagcgaccaatatcttaaaatatccggagcttgggaatccggatacggcaacagaacttcttgatacattagttgagaagaaggcactgacgaaactggttgattcaactttggaatcagattctgataatcatacagggatccaggtttatatcggagaagaatctccggttaagaatatgaaggactgtagtatcgtaactgcaacatatgagcttgcagaaggaggtacaggtaccgttggtatcatcggaccgaagagaatggattacaagaaagttgttaagactttaaagaacctcactgaagaattagatgatatttttaaagacaaatcttaagaaaggaagtgatgtgatgagtaagaaaaacgaaaacatcaacgaagaagtaaagaacgcagaagagactgctgaagatataaaagatacagaaacaaaagaggaagcttccaaagaaacagaagagacaaaggaagcagccgctgatgacaagattgcagaattagaagcgtccgtagctgactggaaagacaaatatcagagactgatggctgaatttgagaacgcaagaaagcgtacagcaaaggaagctacacagcgttatgatatgggagcaatgggagttttagaaaaacttcttccagttattgataacttcgagagaggcttagaagccgtatccgaagaagagaaagactccgcattcgttaaaggaatcgaacagatctataaacagtttgtcgctgtaatggaagatgttggagtaacaccaatggatgcgcaaggaaaagaattcgatgcaaatcttcataacgcagtgatgcatgtcgaagatgatgagttcggtgagaacatcgttgcagaagaattacagaaaggttacatgtacaaagaaaatgtactgcgccatagtatggtaaaagtagctaactaatatttatattatatatagaataagaagaaatcttaggaggacatagatcatgggtaaaattattggtattgacttaggaacaacaaacagttgtgtagcagttatggaaggtggaaaaccaaccgttattacaaatgcagaaggtatgagaacaacaccatctgtagtagcatttacaaagacaggagaacgtgtgatcggtgaacctgcaaaacgtcaggcagttacaaacgctgagaagacaatcgcttctatcaaacgtcatatgggaacagattacaaagttcagatcgatggcaaagcatactctccacaggaaatttcagcaatgatcttacagaaattaaaatcagatgctgaaaactacttaggagagaaagtaacagaagcagttatcactgttccagcttactttaatgatgctcagcgtcaggcaacaaaagatgctggtaagattgcaggacttgatgtaaaacgtatcatcaacgagccaacagcagcagctttatcttatggacttgataacgaagaagaacagaagatcatggtatatgacttaggtggtggtacattcgacgtatctatcatcgagatcggtgatggtgtcatcgaagtattatcaacagcaggagataacaaattaggtggagatgactttgataacgttatcacacagtatatgttagatgaattcaagaaacaggaaggtgttgacttatcaacagataagatggcaatgcagagattaaaagaagcagcagagaaagctaagaaagaattatcttctgcaacaacaacaaacatcaacctgccattcatcacagcaacagctgaaggaccaaaacattttgatatgaaccttacaagagcgaaattcgatgaattaacagctcatttagtagagagaacagcaggacctgtaaactccgcattaaacgatgctggaatgacagcttctgaattaagcaaagtattattagttggtggttctacacgtatcccagccgtacaggacaaagtacagcagttaacaggaaaagaaccattcaaaggaatcaacccagacgaatgtgtagcaatcggagcttctgttcagggtggtaaattagcaggagacgctggtgccggtgatatccttcttctggatgttacaccattatcactgtctatcgagacaatgggtggagttgcaacacgtctgatcgaaagaaatacaacaatccctacaaagaagagtcagattttctcaacagcagaagataatcagagtgctgtagatatcaacgttgtacagggtgagagacagttcgcaaaagataacaaatctttaggaagatttagattagatggtatcgcacctgcaagacgtggagtacctcagatcgaagtaacattcgacattgatgcaaatggtatcgtaaatgtatctgcaaaagaccttggaacaggaaaagaacagcacattacgatcacagctggatctaacatgtctgatgaagatatcaataaagctgtaaaagaagctgctgaattcgaagctgcagataagaaacgtaaagaagcgatcgatgcaagaaacgaagctgattctatcgtattccagacagagaaagccttagaagaagcaggagataaagtagatcctacagaaaaagcagctgtagaagctgacttaaaagatttaaaagatcttgtagaagctacaaaagatcaggatatgacagatgctcaggttgaagatctgaaagctaagaaagacaaactgatgacaagtgctcagaatttatttacaaagatgtatgaagcagcagcacaggctcagcagggagctcagggagcagcagatgcaggagcaaaccagggagcagcaaacgatgatgttgtagatggtgactacaaagaagtataattttaaagagaaggtagactaaaaatggcggaaaaaagagattactatgaagtgctaggcattgatcgtaatgcttcagcatcagaaataaagaaagcctaccgaaaactcgccaagaaatatcatccagatacgaatcctggagataaagaggcagaagccaaatttaaagaagtaacagaagcttatgagatattaagcgactctgaaaagaaagcgcagtatgaccagtatggtcatgctgcctttgagcagggtgctggcggatttaatggcggcggatttggcggttttgatttcggtggtgatatgggagatatctttggtgatattttcggaggtatgttcggtggaggaagccgtggcggagcaagacaggctaatcgtccgacacagggatcacatattcgtgcaagaatccacgtaacatttgaagaagcagtctttggtacatcaaagaaaatagaaattacattaaaagatgaatgtacaacatgtcacggaaccggtgcaaaaccaggtacaagtccagaaacatgtccaaaatgtcagggacgtggtcaggttgtatttacacagcagtctatgtttggaacggtgcagaatgttcagacatgtccagattgtcatggaacaggtaagatcattcgtgataagtgtccagattgtcatggaacaggttatgtaagcaatcgtaagacgatcgaagtgacagtaccagcaggtattgacaacggacagagtatccgtatccgtggcaaaggagagccaggtacaaatggaggcccaagaggagatctgttagtagaagtgatcgtagaaagacatccaaaattccagcgtcaggatacaacgatctattcaacagagccaatttcctttacacaggcagcacttggtggtaagatccagattcctacagtcgatggaccatacgaatacacgatcaaaccaggaacacagacagacaccagaatccgcttaaaaggaaaaggtgtgccaatggtacgtaataagaatgtacgaggagaccactatgtaacacttgtcgttcaggtaccagaacacttaaacggagagcaaagagcagctcttcagaaattccaggaagctatgggtgaagttcctaagaaggaagaagctcataaagaacataaaggtttctttgggaaacataaaaagtaatttgaatgataatcgttcaaatgtatatgataaataataaggatctctcgaccattagaattcgacatgtcattttgacagaattctaatggtcgggagatccttattatttatcatatacatggacggctattcaaaccaccacaggtgtgtatattaaaggttattggcgtacaatttattgatttatattatcactaaaatataagtttaatattgaaaattaaacataatcatgctattgtataaatataaacacagagaaggaggatcaatggatggcaattgaatatttaacaggattaaatgcgattgtaatgaaagctatttggaatattgaaaagagacagggcagagtaacaatacaggatctggtggaagaaataaaaaggaatacagggaaagaatatcataggaatagtgtttcgacttatttgagaagattggagaagaaagatttcatagagacaaagaaagaaggaagaagaagttttatttattcgaaagttgatgaatcagattatcataaagtgcagtttgagcagatgaaaaaagtatggtttgatgattcatgggatgaattttcagtagctctttctgacgtagtaaaacaagagaagaatgataaattacggaggttgatcgatgatctggatgattcagcagattagcatttatatattgtgctatttatttatctgtcttctcataggaagtatattgtttcttatatggaagattctatgtaaaaagatggaggagaaaggatttgtcaggctgaattatggattgttaaagattgtcatcttgttttttttgattccatttccaattgtaatcctaaggacggttctttgggatggaattacctttttggtaaatgacaggataggaaattttgcaatatgtatggtagggatatggggaataggatttggaatcagcatatggaaaagcaaacgtaaggagagggtatttttagatatatgtcagtcaggaaaaacatgtagagaatggatttcaaagcaagcgctagaattaatggaaaaatttgagattcataattctgtaagtgttgaatacaacccatttgtacagacaccgatggtatatggaataaggaatccaaaagttttacttccgacagaagaatataccacagaccagctaaagattattttattgcatgagctgacacatataaaacataaggatatcttttggaaactattatgcagaatgattttactgatctactggttttatccattaaaacgtcaaatatttaaagcagtgaatgaatggagtgaagtctattgcgatttcagtgtgatcaatgagacgggaagcaagaagggatattttaagacaatctatgatattatgattcatcaatttcagttccaggaatatatctgtgcaggaattggggaatgtaacttggaacgaagaatattaatcgcaaagaatattaagagaatgaatacggagaaatggatcataggttttattttgagcatgtgttttatattatttgggggaatcagtgttgttactgcaatggagtcaatgcaatttggatatagaattttagatagaaatacatcagagggtatagaagtagacggaacaccagaaatattgaatttaaaattacacgatagagataataatgaatttgaaatttcaagaattaaatatttacagagtagtgatgctatttataacatagataaaatagaggctaaggaatgcctacaaacaaaatggatatatttaagaaaaggacagaaagtatttttcaaaatgtatgcttatgatacaacaaatgaatctacaaaaaataggaaattgcagacaggaattattgattattcaaaacatataaaatatgttgagaacaacgaagaaattgcttatatatttaaaattcccaaaaacggaaagtatcgatgttatgtttataattgtagtgattttaaaacgcaattattaggagaaattgaaattttaaatgattaggagaaaatgaaatgaaaaaaattttatataatatttgtataatgattatcataattatttgtcctataaatgtatgggcaagtgatgatttaatagttataaatgatcaagaaaaaatcaatatagaatatgtagaaatttctaatgatccagaattgttttcgagagaacataagatttctatgagtgttaatccgaatacagaaaaaagggtaggaagttataaattaaaagctaatcaatatgttacgttaaaaatttcatattcttcaactaataaaataagagttggaattgttagtaagagtagaaaatatgtggcattaaaaaatattaaatccaatgatatacagagaataaaagtaggggaaacagatacatattggatatttgtgcaaaataactcaaataaaaaaataacagttaatggggtatatatatgttaaatagatgataggtaatatatttatttatcaaaagaaggtgatgcttatgatttagaaaaaatccatataacacgaatggcgaccaaccaaaaatccttttaaaaggacaagtattatatagatataaaaagtatatcataaattgggaattaaagcaagatataatagttatttgcaatatatattatagcaataaaaattatgaatgtttttaaatgaaagatattgaacaaaagatgtgtgaattaataaaatataaaaacttaagttcacacagacaaaagaaaggagtttaaaatgctaaaattaaacaaattatttatgaaaggaattacattgattattgcatttggaatgatttgtgtttccaatagtaccgaaatatttgcatcagaatccgaaccatgtactgaaagttcaagaactgtttattataatgcatatactcaagcactccaggaggcagaagaaacaggttctgaaaacgaaattgaaaaaacaaaaaatgaattttcagattatgtttatgatttacaaaaaaatgaatctgatgaaactttatctaatatgggatataatcaacagcaaataaatttaattcgacagtatgatggaagtcaagatattatagcattatttagtggttcagtaactatcacaaataaaattgaaaattataaatataattcttcaacgaaacaaaccagtgcagatattgcttttacatttacatggaatggaacttctgcatataatcataaagatgttttggcagtagcttggtcagaaggtttatacactaactcaaaaaatataaagattacttgtacttataaatcaaatagaaataacacaaaaatttctttctcagctccaagtagctctccttatgtagcaaaaaatgtagttggaactggtaatcagagtgctaaatttacttttgataagcattatggaagtagaatgcgtctttattctgccactggtaaagttcatgtgacaaaaaaagcgaaagtacctgaattttcttcttatgtgagctatggagaaacaaaaactaatatttccccatctttttcagtaagtattaaaaatctaagtatttctatttcatttaaaaaaaatattagtgaaattgcaagcaaaagatgttataaaaagttataatagtctatagtaaatattatgaattttagctaaggaggaacaaactatggaacatattatagttttatttatattagcactatgctttttttcatttttttattttttatatcatgtgcttgtgaaattacaaaacaaagaaaacttttccgatgaatataaattaatggttgcttcgtgcgttgtttttgttttcatactgttattttagtttcatacatgcagaatgggggatgctataaataataatatgatgtgggtgtcaaaagtaatgattttatgaatttgcttatgatttaggaaaaatccatataacacgaatggcgaccaaccaaaatcctttcaaaaggataagtattatatggatatagagaagtatatcataaattatagtttaaaacaaaataattataaacaaagttttctcaggttctctgaagaaaggagacaaatatgtttaaaatcgcaaaaaaattaacagttataatgttatctgcaagtataatattttcttgttctgggatcattgcacatgcagaagggataaaagataaaaagcaagaatactatcaggaatataaaagaattattagagaagcaaatgaaaaaataggaagtaaagattttgagctgcttccgatcgatgaaattaatgaagatgatatgttaacaccgaaagaatttcaaaaggcagtcaatgcagcaattcaattagatactcaaaaacctgttatagatgacaatggcggggaatattccaatgaatctaatgataatatgtctgccagagcttctggagaaacagtgacagaaagtcagaataagaaagtatctgtggctgataatcattctgttataatgaaatgtacagcaacttttgtgacacgctataatgcatctaaaaaacgtagatttataacacaaataaaaagtgctaaagtaacagtaagtggttatggattttcatggaagaagtcacctacaattacaaaacgtgtgatcgatggtggcagaacaggagaaattttatgtttaggagtcataaaaaatccttctggttttacaaagcaggtttctctgtcatttgaattttattgcaatacagggggaggaattgaagttcgttaaatttcataagtggagagggctgtcatagcagccctttccttagttcattaaaacatgaattagtaaacgatttagacattcataataggaggatattgttgatgaatgtaattataactttgattattagtattttatttataataggaattattttattaataatgggactaattaaattgataaaaaaataatagggggagacaaattccatgactaacataagttagtctagaatttgcctacattatcctgaccaaagtaatgtgcgtaaggcgtcgtagaccttatgaatttagaaggaattgtgttagatggtacaccaaaagtaatgaattaaaaattttagagaaatagtagagaaggtaaaaattatcaaaatgagacaaacggaaagaaattcttaagagaggaggaacaactatggagcatattatagttttatttatattagcactatgttttttttcatttttttattttttatatcatgtgcttgtgaaattacaaaacaaagaaaacttttccgatgaatataaattaatggttgcatcgtgcgttgtttttgttttcatactgttattttagaaggtgatatttatgatttagaaaaagtctatataatatgaataacaattaaccaaagaatttcaaaaggcagtcaattcagcaattcaattagatactcaaaaacctgttatagatgacaatggcggggaatattccaatgaatcgaatgataatatgactgccagagcttctggagagacagtgacagaaagtcaaaataagaaagtatcagtgtctgataatcattctgttacagtgaaatgtacggcaacttttgtgacacgctataatgcatctaaaaaacgtagatttataacacaaataaaaagtgcaaaaataacggtaagtggttatggattttcatagaagaagtcacctacgattacaaaacgtgtgatcggagactgtttcaagttttgtgtaaacacaaaaaactgatataagattaatcaatagttatgagggttatgagtcaaattttgactcatagcccttatctgcattatacaaaagattttaggcatgtcaaataaacctgtctaaaaacacagatttttaatacatatatttttctaatcgttcttcaaaaaatatatctaattgtgcacggatctggctccagtctcttctgcgaccagtccatttttttgtgatgtccatcgttgccaaataaagcatttttaataagctgtcatcagttggaaatacagttttgctttttgtcacttttcgcaactgacgattgaatccttcgatggcatttgttgtataaataagttttctaacctgttctggatatttaaaataagtagccagtgttgcccagcgttcgctccatgatttatagatttttggatattttgagttccacttttctccgaaatcttcaagattttctaaagcgatctcttccgttggtgcagcatagactgcctttaggtcagccattacttttcgattgtctttataagatacatatcttgtggtatttcgtatctgatgaatgatgcactgttgtatctctgtctgtggaaatacagcttcgattgcctgtggaaatcctgtcagtccatccacacatgtgatcagaatatcttcaacgccacgatttttcagcccattgatgatagaaagccaaaatttagcactttcattatcacccacatacattccaaggacttcttttttaccatccatgttgaccccaagagcgatataaacagcacgttttataattcggccttcacttcgcacatgatagtggattgcatccatataaacaactgcatagacttcttccaaaggtctttcctgctattcttttacgatcggaaggatcttatctgtaatcctgctgatcgtactgtctgatatatcaatgtcgtagagttctttcttgtgagattcaatatctccggtcgtcatgccttttgcatacatggagagaatcttttcctccatgtcctgggtaacagtattctgatattttttgattaatctgggttcatattcgccattacgatcacgaggaacagcgatttccatatccccataactggtatgcatggttttcccagaatgaccattgcgactgttattggtatctttattacgataatcatatctggaatagcctagttcctcattaagttcttcatccagagcaccttcaaggatcactgacatcatatcacgcatgattgcattaacatctgttccattttttacactgatatcattgtcctttaaatatccttgcattaattgtcttaatgctgctttttgtggtgtgtctccttttcttcttcccataaaaaaacctccaaactgagtaatattatcttacatcagtttgaaggtttacacaaactttgggatactcccgaaagattagtgtcttacctcttattaatcctatcaataagtgaattaacactttcagctaattcctttttcaaatccccaaacatttctctaatagccactttctttcgaatcaaaaataaaccaatcacgatcaaaacaacaacaggcaacatccatcttaatgcacccatccaaaagctggcagcagtacttccacgatagcttaattccaaacgatttccagtcaattcaaaatcacaaagatcatgaatattctcatccgacttgatcagggcagagactgctttggtagatgtattctgttttaccgtatttgtcacaatcttctcaggcataacagctacagtaacagattctttcgaattcacagaagcaaatacataatgcccatgaagtttctcaccattttgattcgcaggtaatgaaatcttatcagaaaatgtgaccttcttaccaccagcaaatgaaaaatgcgcttgtgatttcatcaaactattcggaaacaaagcagagaaatccttattacagtctgaaacacttcctttttgtacaaaagataacgtaacattctgatcaccatctaaatttacagaatcaatggtttgtcctttgaactgctttttgatcacagataactgatggtcagtcacagccttttcaaaagaaaaagacactttacgacggatatctttggatgtgttccataccgtagcaatctcataagttgaaattggctgtgtaacagaagaagtaaagctgatttctttttgtttgatcgaatcactaaacatctgtttttcatcaaatgtataagtaacaggaatcttttggtttttctgaataaaatgagagagatccagagattcttcatagttgatcttcagtgtaaaagggttgtccttgctgcatgtggagctgtaagttccaaaagaattctttgaatgaaggacagttcttgttttctgtgcaagatcagagaaattgttggcgtcaaaactgatacataaagtttttccatcggatgtattttcccaagtgatatcatttccagcaaaataagaacggatctttcctgcattttgatctaatgtttgttgtggaagatcaaattctatcactcttgcaagttttccagatttctttgtctttgtatcaatatgaatggaagataatggtacataagccatttcatcaatgttgatcttatctttcgtctcataagtttttccaaggaaagaaatcttcgtactttttaaatcccataggtcagaagaggagtctttgtcaatatattttccctcatacaaagctgtataaagccatgtcatcagatctttggatgtgaaattttctttataaataagacctgagacaaatggagaatctccatattcataagtgatctctggggaaaaattaagaagatcacgaactttcttcttataatcatcaagagaagaaaaacgaagatagaaagtatacgcatcgtttccgtcagaagaagatgaagtataagtaagagcatccgggcaggattctttgataagtttattaagatcttctttgcttcccttgaaataactatgaaaatcgcgggaagaaaaggtacaagacatcactcttgtacctgaaaagcctttatttaattttactgtactggtaagattcacaccgcacccgcataagagaagcagtgagaacagtaatccaaaaagaaaaacttttttcttcataagggtctccttattatttgagattagctaaataagtatcattaatcgcaataacttttttcatagcatcacgtcctggagctccgatcgtattacgtttttcaacgcaagttttcatgctgatggcatcataaatatcttcttcgaaagcagggctgatcttctggtattcatctagaggaagttcatctagagaaatatgtttatcaagacaaagaagtacaagctgcccaacgattccgtgagcatcgcggaaaggaacaccgtgatttacaagataatccgcagcatcagttgcatttgtaaatccgtgttttgcacttttttccatctgtggtttgttaaatgtcatggtattcatcattccattaaataaagaaatacatcctttgacagtatcgatcgcgtcaaatgtaagttctttatcttcctgcatatctttgttatatgccagagggattcctttcattgttgtaaggatagaagttaaagctccatagacacgtcctgtcttaccacgaactaactcagcaatatcaggattctttttctgaggcatgatactgcttcctgtactgaatccgtcatcaatggatacaaatttgtattcgttagagttccagatgataacttcttcactgaaacggcttaaatgcatcatgatcgtagatagagcagataaaagctcgatcacataatcacggtcagatacagaatccatactgtttaatgtaggaccataaaaattaagcaaagaagctgtttgttcacggtctaatggataagtagtacctgcaagagcaccagctcctaaaggacagtagttcattctgtcataaatgtcagttaaacggctgtaatctcttttaaacatttccatgtaagcacctacatggtgagcaagagtgacaggctgagctttctgaagatgtgtaaatccaggcataaatgtatcaatgtgttctttcatgatacgatgaagtgtttccattaattcttttaataaatatttgatatcaacaatttcatctcttgtataaagtttcatatctaaagcgacctgatcattacggcttcttccagtgtgaagtttctttccaacatcaccgatgcgatcaataaggtttgcctctacaaagctatggatatcttcatattcacttgtgatctcaactgctccagtttggatatcctttgaaattccttttaaaccatcgatgatctgatcacgttcttcttctgttaatacaccaacacttgcaagcatcgtaacatgtgcaatacttccgcggatgtcttgtttataaaatttctggtcaaaggaaatagatgcattaaagttgtaaactaactgatctgtttcttttgtgaagcgaccgccccataattgtgccataagtgtttcctcttttctgtatatatttttattctttatcataaaatcaaatgaatttacttttctattctacatgaaataactcgattttgccacaaattttttgcatcaaaggggaaaaatttatttttgatactctcatcatatagattttttgaatttaagatagaatagacagagaaaaattaacgcacaataaaaagaaagttatgaaaatgggcggtgactatgaaaaagagatatcagatagaaaaatatacaatcctgtttgcgattggaggaatggcatattttttgctggaagttttagtacgtggatattcacattattcgatgtttttatgtggtggggcatgtttcctttgctgtgggcttctaaacgaaaatgtaaagatcaagataagttttattagtcagatggtattatcttctgtgatcatcacggtattagaacttattacaggttttattgtaaatatatggcttaagatggatatttgggattattcgcatcttccatataactttaaggggcagatctgtttattgtactcggtattttggtttcttatttcaagtgtagcaatcgtgctggatgattttctaagatacaaattattcaatgaagaaaagccacgttataagattttttaagaatgtagtataaatagcagttcacagggaaagctatcgacatttgagggaaattctgttaatctattataggtacaaatagtagattggaggaacaacaaaatgaaatttacaatgggaaggacaatgaagatccttgtagcaattttgatcgtagcaatcattgcgatcgttatgctctcaccatattcttttgaaaaatatacagcatcatctaaaatgattcaggttacttcgactgatactgtaacaaaagatgcaaatggtaagaaaaaacagcaggtatattcatataaaaaagatgataaaaaatacacagagatcgttaatgttttagatcagtattcttatcattttacaacaaagacattaactaactcatctcagatgagtgattctagtaagccacagatgatcatgttatttggaaataaaatgcttgtgatcagtgattcaggagaaatccttctagataatcatgtataccgcatgggatattctggtggaaaagatgcgaaaaaaatgatgaaaagcatcaacaagattttaaagagtgaataaaatataataggggaagacatcatgggatataaacgtctttataaaaatttgatcgacattatcaaggaagaacaggcaaaattgggatttcgaagagaaagtatccgtctgtactatccattaagttcgttaaaccatttttttgaaacacaggatacagaagaacagatgaaaaacagacttcatggaataccagattttatcaaagaaactttaggagatatcaaagttactagcaaaaaagaaagattttgcttctatattccagaagaaggcagtaactacgtccatgaaaatacaaacccaaatgaatttatcaaagaactggtagaaatcgttggaaaacacggatgtaaaatggaagatattattgcgttatttaaacaacatgataaaaacgtgtttgtagaagaaattcataatggagaatttgattatctgatccgtttttcagaagaaaatgaagatccatattattactgttttcacgatgaaggatgtcacatcatctatcaccgctttttaccagaagattatgaagatttcggattttaaacaatgttattaagaatatatacaggagaaataagttatgagtgaattattagacatgatcaaaacaagaagaagcataagaaaatacaaatcagatatggtaccaaaagagatcattgataagatcgtagaagcaggaacttacgcagccacaggaatgggacagcagtcaccgatcattcttgcagttacgaacaaagaagtgagagataaactgtctaaatggaatgcagatatcatgggaacagacaccgacccattttatggagcacctgttgtattggttgtcttagcagacaaaaaccgtccaacagcagtctatgacggaagtcttgttatggcaaatctaatgttagaagctcatgatttaggaatcggaagctgttggatccacagagcaaaagaagaatttgaaagtgaagaagggaaagaattattaaaatctctgggaattgaaggggattatgttggaatcggacattgcgtacttggatatgtcgatggagagtatccgggaattcctgaacgtaaagataattgggtgtactatgtagaataaatttgctggtttaatgacgaaaattattggtggaatattataaaaagggttatctgtctgcgacgcgctctcgctcgactcacacgcagctgtactaagtttctgaatggtctaacgaccatccattcactaagtgcaggcgtgttcctacggtctcagacagataaccctttttataatattcaaataatttatgtaatcgaaaccattaccgaacgtgtatggagaatgatcttggatgtaaattagttttttcaagacagaagataagtgtttattatactcctaaacatctcaacaaattggtgcttgtttaagcacctttcatcttctggtaataaatacaaaaatcatcgaccaataccgtttaacatacacactgtgtggtagtttgaatagacttcaggtgtatgtgacagaaataaaagaaaaacaaatatttaaaagaatcaaggtggcaaacatgagcactttttgagtgcgttttttacaaattcgcagtgcctgtggttggatgtttgaccgttgctgcgggcattttggctcgcagcgagggagacaatatgtaatgacccccaagtttgtaggatcgtggatttacctgtatactatgaattggaaactaacaatggtaacagggattaccgcatacaaattggaggtcattatatgaattataacacagtttacgtaggaatggacgttcataaggaaagttttactctttgttcttgtaaatatgaagatgaaaaggcatctcattaccagagaacaccagccagttacaagaatgtattaagatatcttgcatttcttcgcactatatatggagaggatacaagatttgtgtgtggctacgaagcaggatgccttgggtattctttgtatcatcaattggaaaattttaatgtggaatgtgtgatccttgcaccaactacaatgctcgaacaacgaagcaaaagacggatcaaaacagacaaaagagatgcggagatcattgccagatccttggcacagcacaattacagtccggtacatattccaacggaaacagataatcagacaaaagaattcatccgtatgcgtgatgatcataaagcggaattgaaaaagatcaaacaacagatcctttctttctgtttacgtcagggttatcagtatgatggaagtggtaactggacagcaaaacatgtgaaatggctgagatcattaaaaccagcagggctttacaaagagatcctggatgaatatctgctgacttatacaattctgacagataaactgaaccgtttggatcagaggattgaagaactagcatccaaagaagagtataaagaatctgtcagtaagttaacctgttttctaggaatcaagacacatactgcgttatctgtaattgttgaagttggagactttcagcgttttgtatctgcacgaaagtttgcagggtatcttggattggtacctggacagcattccagtggcgatgacagaaacggacttggcattacaaaagcagggaacacccatgtacgcagactgttggtagaatccgcacaaagttatacccgtggaaagatcggatataaatcaagagtcttaagatcacgacaggcgggaaattcaccgcaggtaatcaattatgcagacagggcaaatgagcgtctgagacggcgctattataagatggttctgaaagatggcaagaaatataatattgcaaaaacagcaattgcaagagagcttgcttgtttcatatggggaatgatgacagataatatttactaatataaatataacacatcgatcaccatatcaagaccaagccgccaaaggcggtactgtgtagtcttgacatactgatcgatgtgctagaaatgataatcaagatgatgtaagccggtctctgccgcatacatcatccagcctgtaattaaagttgcaactgaaggcatcccgaaagagtttcgaacatgtttaggtttgaactatctacgaggaaactctgttggcacagtaatatctgtgatccacgtgagggagacagctagagttcgcggcggaccattgacctgttggtaaccaatccacgtatatcagagtggccaatgccgggaactgatacatcggaactctttctggatatcttcagaaacaataaaataaaaatttgttgtaatttctgttaatttactattgacaaaggtcattacatatcagtttccaaaggaacaggcacggatcagcgatttgtaaaaaacgctctcaaaaatgcggagttgccaccttgattcttttaaatatttgtttttcttttatttctgtcacatacatgcaagcctatatacaatcacaatttatttattgttattcttctcagcttcctgcatcttcatagcacgaacttttaaaggaagtccaaataatgtaataaatccatccgcatcatgatgatcatacatatcaccagttgtgaaagatgctaaagattcgttgtataagctgtatggagaagtagttccagccttgatgatattacctttgtaaagtttgaatttaacttcacctgttacatactgctgagtagatgtaacgaatgcctggattgcttcacgaagtggtgtgaaccattttccttcgtatacaacctgagccatctggcttccaagtttcttcttagcttccattgtttcacggtcaaggattaattcttctaactgatcgtgagctgccattaagattgttccacctggagtttcatatacaccacgggatttcattcctacaacacggttctcaacgatatcaacgataccgataccattttcaccaccaagacggtttaattcagtgatgatctcagaaactttcatttcttttccgtttaatgttttaggaacaccagcttcaaatgtcatagtaacttctgtatctttatctggagcgttttctggagctactcctaaaacaagcatgttgtcgtagtttggtgctaaagaaggatcttctaattcaagaccttcgtgactgatatgccataagttacggtcacggctgtagctgtggcttgcgtcaaatggaaggtggattccgtgtgcttcacagaattcgatctcatcttcacgagactgcattgtccatacatctgtcatacgccatggagcaatgatcttgatgtctggagctaatgctttgataccaagttcgaaacggatctggtcatttccttttcctgtagcaccgtggcagatcgcaacagcattttcttttctggcgatttcaactaatttcttagcgattgctggacgagccatagatgttccaagaagatactgatgttcgtatacagcaccagcctgtacgcatggcatgatatagttatcgcagaaatcatcaacgatatcttcgatatataatttagatgctccggataattttgctctttcatcaagtccatctaattcgttaccctgtccacagttaacacagcaacagataacttcatagtcaaatgtttccttaagccaaggaatcagagctgtagtatcaagacctccggaatatgctaaaacaactttttctttcatgaaataaatcctcctaagtgtatattgacgggatgttttcctattatatataggatctgatattgaaaatcccgtatgttcatataaatatttgcttgtttactaatatacgttatatttacatcttttgcaaggattattttcgaaaataatgaatatttataatataaaaatgaataaaatgaaaaataattgcatatttatacaaaactattgcatattttaaaattcagttgtatacttatgaacaatgattaaaaaaataacctacattataaagagaaggacaaggagattaacatgatcaaagcaggaatcattggatccacaggttacgcaggacaagaacttgtaagaatccttacacagcataaaaatgcagaggttgtatggtatggatccagaagttatatagaccagaaatattatgaagtatttagaaatatgttccagatcgttgatgacaaatgtctggatgataacatggatgagcttgcatctaaagtggatgtgatttttacagcaacaccgcagggactttgtagttctttagtatcagaagaaatcttatctaaagttaagatcattgatctaagtgcggacttccgtattaaagatgtaaatcgatatgaagaatggtatgggatcaaacatcagagcccagaatttattgatgaggcagtttatggactttgcgagatcaatcgtgaagatatcaagaaagcacgactgatcgctaacccaggatgctatccaacatgttctacattatccatttatccaatggcgaaagaaggactcattgagatgaacagtgtgatcatcgatgctaaatcaggaacatccggagctggacgtggtgcgaaagtcaataacttatattgtgaagtaaatgaaaatatcaaagcatatggagttgcaactcacagacatacgccagagatcgaagatcagttaagctatgcatctggagaagaagtattattaaacttcacaccacacttaattccaatgaaccgtggaattttagtgacagcatatgcaacacttaagaaagatgtaagttacgaagaagtgaaagcaatctacgactcttattataagaatgaaaaattcgtcagagtgttagataaagatgtctgccctgagacaagatgggtagagggaagtaactatgtggatgtcaactttaagatcgataaacgtacaaaccgtattatcatgatgggtgccatggacaaccttgtaaaaggtgcagctggacaggccgtacagaacatgaatcttatgtttggattaaaagaaactgaaggattagaattagtaccaatgttcccatagagctttggtaaggaaggactagaattatgaagatcatcaatgccggagtaacagctccaaaaggttttaaatgtgcaggacttcgtgctggagtgaaaccagggaagacaaacaaggatatggcaatgatcgtaagtgaagtgccagcaaagatcgcaggaacatttacaaagaatattgtaaaagcggctccagttttatggggaaagaagatcgtagaagaacaagaagcagtcagagcagtggtaattaatacaggaattgccaatgcatgtacgggtgcacagggatatgagaatgttgtaacagaagcaaaagaagtagcaaaattgttagatattaaaccagaggaagttgtcgtaggttccacaggagttatcggacagcagctgccaatggatgtgatcaaagaagggatcaagaaattagttccagaattaaaagcagacagacaaagtgaagaagatgcatcctgggctatccttacaaccgatacaaaaccaaaagaagcggcagtagaagtagagattgatggaaagacagttacaattgcaggtatgtgcaaaggttctggaatgatccacccaaacatgggaacaatgcttggatttatcactacagatgcagcaatcgataaagctttattattagaactgcagagggaactcattgaagatacattcaatatggtatcagttgatggagatacatctacaaatgatacggtttttgtatttgcaaatggaatggcagaaaataaagaaattacagaaaaagatgcagactatgaagcattcagagaaggattattatatgttaaccagtctcttgcaaaacagatcgcaggggatggagaaggatgtacacgtttatttgaagttcatgtagctggtgcagactccaaagaaaatgcgaagatcttaagcaaatctgtcgtaacatcaagtcttacaaaagcagcaatttacggaaaagatgcaaactggggaagaattctttgtgcacttggctatgctggagttgattttgatccagtcaaggttgatattagtttaaaaagtgcggatggtgtgatcgagatcgtaaaagacggaattgcaacagattattctgaagatgaggcaacgaaagtattatctgcagatgcagtgacagcagatattgatgttcataatggagtgtttgaagcaactgcatggggatgtgatctgacacacgattatgtaacaattaatgcagattaccgatcataagaataagattattatagatagacgacaaaataaaaggcataaaagcagacaactatgaaaggaagaatcaatggaacagatgagaaatgaaattaacgaattgatcgagcagtcaaaacaaaaagcaaaagtattaacagaggcattaccatatatccgtcgtttcaataactgttacgttgttgtaaaatacggtggaagcgctatgaaagacaagaatcttcaaaaaagcgtgatcagagatgttgcactattaaaactagtaggtatgaaaccgatcatcgtacatggtggtggaaaagagatcagtaaatgggttcgtatgtcaggaaaagaaccagaattttaccatggacttcgtgtgacagataaagagacaatggaagttgctgaaatggtattatttaaagtcaatcaggaactggtggccatgatggcagaagttggggttaaagccgtaggtctttctggaaaagatgctgaaatgatccgtgtaaagaaaaaagaaatgcctggaaaagatcttggatatgtcggtgaggttaagagtgtcgatacaacacttcttgaagcattgattgaagatgattttgtaccagttatttctccaattggtttaggagataactatgaaccatataatattaatgcggatgacacagcatgtgcagttgcagaagcattgaatgcagagaaactggtattcttaactgatatcgaaggggtattcgtagatccagaagataaatcaacattgatctctgagatggatcttaaacaggcaaaagaatttatcgataacggagttgttggaggaggaatgcttccaaaacttaagaactgtattgaagcgatcgaaggtggagtatccagagtccatatcttagatggacgtttaacaaactgtctgttactggaattcttcacagaaaaaggtattggaacagccatcttaaaagaaccattatttgataaaccattattcaacgaagaagatgaggaaggatgttaagatgaaaacgcagcaggaatatattgagcagggagaacagtatatcttaaagacatacaatcgttttccggttgtattagaaaaagggaaaggtgtctatttatatgatgctgaccagaagaaatatctggattttggtgcaggaattgctgtatttgcattaggatatggaaatgaagcatacaatcaggcattaaaagaccagattgataaattgatccatacatcaaacttatattacaatattccagcagtagaagctgcaaagaagattgtcgatgcttcagggcttaaaaaagtgttctttacaaacagtggaacagaagcaatcgaaggtgcgttaaaagttgcaagaaaatatgcatataataaagacgattccaaagattatgaatttatcgcaatgaatcattcattccacggaagaagccagggagctttatcagtgactggtaacagtcattatcaggatggatttgttccaaaagaatttcgtgctgtatttgcagaattcaataacttagaagatgttgtatcaaagatcacagataaaacttgtggaatcatatgtgaagttgttcagggtgaaggtggaattttcccagcggataaagaattcttagagggacttcgtaaagtctgcgatgagaaagatatcttactgatctttgatgagattcagtgtggaatggggcgctgtggatctttgtttgcacatgatctttatggagtaaaaccggatgtcttaacacttgcaaaagcgcttggatgtggtgttcctgttggggcgtttgttgtaggtgaaaaggctgatggggctttagtaccaggtgatcatggaacaacttatggtggaaatccattcgcagcagcggcgatcaatgcagtatttgaccagtttgagaagttacaggttccagaacatgcaaaagaaatcggagcttacctgtgggataaattagaagagttaaaagagagatatgactgtatcacaggacatcgtggaattgcattaatgcaaggacttgaatttgatgcagatcatccagttggagatatcgttaagaaagcactggagaaaggattgatcataatttctgcaggaaataatgtcattcgttttgtaccgccgcttgtgattgaaaaagaacatgtagatgagatgatttctattttagaagattgtatcgcatagaatgtataaaaaagacctctatggaaaaactatccgtaaaaagatagtttttcatggaggtttttatatgtttggattgatcattgcattgatttcgggagctttaatgagtattcaaggtgtatttaacacagaagtaactaaacaaagcagtacatggacaacgagtacatttgtacaggcaacaggatttctcgcatgtttgttgatctggttgatcgctgagagggaccaaagtttcacgatgcttttaaaggtcagcccaagataccttttattaggaggagtgatcggagctgcaatcacatttacagtgatcaaaagtgtggcaagtttaggacctgcacagtcagcaatgctgattgtcgcatcacaaagtgttgtttcctatctgatcgaggttttcggtctgtttggtgtggaaaaaacagcttttgcatgggtaaagcttttaggagtggttttgtttgtcacaggattgataatatttaaatggaaatcataaatatctcttgtaaagtattataattttcgttaaaatagaagttagatttacatgttccagactctttgcataagaccgggaggtttatgttgtttaggagagttaaagtgataaccattttgctgatggtttttatgatgtccattggatgcagccgcaggaaggaagtatcgatagaaccaaagaaggagacaaagacaacggctgagaagtcttcttctaaggaaactatttatgtctatgtatgtggagaagtaaaacatccgggagtttatcgtttttcgaaggacgaacgcatcgtttctgctgtgaaagcagctggtggactaactaagaaggcttcagcagagagtattaatcaggcagagaagatgaaagacgggcagcagataacgattccgtcaaagaaacagacagcgaagaatgaaggatctgattccaaagcagtgcaatcttcctctggaaagatcaatatcaatactgcaggtgtcaaggagttgatgacactttcagggataggggaagcgaaggcttctgatattatctcttatcgagaggaacatggccctttttctgatatttcagatattatgaagattcagggaattaaagaggggatatatcataagatcaaagacaagataacaatataattttagaggtggaaaaatgaggaaggtcttagttgttgatgatgaaaaactaatcgtgaagggcatcaaattcagtctggaacaagatgagatgcaagtagattgtgcttatgatggagaagaagcattagagaaagccaaagagaatcaatatgatattattcttcttgatgtaatgcttccaggactgactgggtttgaggtttgtcaggcaattcgtgaattctctagcgtcccgatcattatgttgacggctaagggagaagatatggataagattcttggccttgaatatggggcagatgattatatcacaaagccatttaatattctggaagtaaaggcaaggatcaaagcaatcttacgtcgaagcgcacatcacgatgtgaaagaagaagaatcagcaaaggttgtagaatgcagaggtttaaagattgactgcgaaagccgcagagtgcatattcatggcaaagaagtgaacctgacagcgaaagaatttgacttgttagagttactggtatttcatccaaacaaagtatacagcagagaggatttgttgaatacagtatggggatatgattatccgggggatgcaagaacggttgacgtgcatatccgaagattgagagagaagatcgaagtgaatccgggagtaccggactatgtacatacaaagtggggggtaggttactattttcagtcctaagaagaacagatttgcctttttacatagtatgcagttctttattttcttgtcagttttccttctgacgacattgatatcagttttatttagtaagttgttaaatgatggatatcgtcagaaaacatatgaccagaaagtggatagtgtggtcagtcagtgtagctggcttggtgatcaggtagttggagtcgattttcatttagatgatggctccaactctctttctaatcagattgatgaacttgcagcaagtatgaatgggcggatcatcgtaattaagaataattataagatcatcaaggatactcatacagattttcagtctagattctttttaaatgataatgtattggatgttatggatggaaagaagacaaggattgtatcagagagtggaaagtatatcgaagtgatggttccaatcgtatcaaaagctggaaagcagaatcatatcctgggagttgtgcaggcgactgtgccatctgaggatatgatgggagcagttacggagatggagcatcgcaggaatatgctgctggtagcatgtatcatctgtggattatcaatggcaatgatcatcagttatctgctgacgagagatttaaagaagattcagagagatgttgattttattgcggctggtcatgaagatgaatccattgaagagacaggatttctagaagtacgcagtattgtgcagcgttttaatgagattcttggaagaatgcagacgttggaagattcaagacaggagtttgtatcgaatgtatcgcatgagttaaagacaccaatgacatcgatgaaagttcttgcagattccttaattcagcagggagatcaggttccagctgaattatatcgagaattcatgcaggatatcgttgctgagatcgatcgtgagaacgtgatcatttcagatctgttatctctggtgaaactagacaagaaagcagcgcagcttcagatcacaacagtaagtatcaatgaattgttagagattatcatgaagcgtttaaaaccattggctctgcagcgtaatatcgaattgatctttgaaagtttccgtccggtaacagcagagattgatgaagtgaagttgtctttagggcttacgaatctgatcgagaatggtatcaagtataacaaagatgatgggtggatccgcgtgacactgaatgcagatcataagtatttttatgtgaaagttgcagattctggtgttggaattcctgaggattgccaggatcaggtatttgatcgtttttatcgcgtggataaagcaagatcaagagatactggaggtacaggacttggattagcgatcacaaagagcgttgtttctcttcataatggagagattaagttatacagtaaggttggtgaaggaacaacatttacacttagaattccattaaagtataaaggctaggaggaagagatgaagaaaagaaaattatgcatgatctttttgctttgtctggctttgatgactttagtggtaggatgccggtcaaaaaaagaaaccaatgaccaaggcaatcaaaaaggaacagcaatttactatactaataatgatgttacgaaattgatcatgaagaaagaaaatgtgaagcttgaagggaatcagcagcagaaagtgaagattttattaaagaaacttcaacagactccaaagagtgataagatacgctcagtgattccaaagagaattatgatcaatggtgtatcagtgaatacaaatatcgttgagattgatttttcgacagggtataaacgaatttcagagaatagagatttgatctgccgtgctggtattgtatatacactgactcagttaaaagatatcaattatgtatcattttcaatttctggagagccaatgcttgatacagatggtacagcaattggtgctcttggaagagatagttttgtatttggtaagttgccaatgaaataatttatgaaacaaagaccgatggttcttatatttgccggagtgttatccggaacagccgttgtatggaatattatgtccatgacagcggctttttatctattgacaggtatttgtctgttggcgtccttgatttttagtgataggcgttatggatggggtgtagttggaatacttgcaggaattttattatcgttaggttttaagacttccatgaaacttgatctgatccaggtaaaggaaaaggcaacagaatatacaatgggaagagttttagaagtatcgaaaacaaagaagggaaagttagcagtacttttaaaaaataaaaatttggaggggaagatccttttatatacacccgaggatgaaaagatcattccaggagatattcttcggtttcaaggagaattagaagaatgggaagatacagctaaccctggtcaattttcaagcagacattattatttcagtaaaggaatttactatcatgtatattcgaaaaatattgagatcgaaggacatcaaaatatatattttcaggaaaagatcttgcaatgtagagagtacatgaaacatcagttagaaattcaatacaaaaatgaagtaagtgatttcttaaaggggatgttaataggtgataaaaatggactgagtgatgaggttaaagatgactttaaggaaagtggattaattcatttacttgcggtatcaggacttcatatatcgttggcaggaagaagggtatataaattggttcgcaagtggtgtggaaattttgtagttggttcactggcaggaatgacaggcgcagtgttttattgtattttaacaggtggatcgggatcgtcacttcgtgcagtgatgatgttgggtgtttacttcctgtcagagatattaggagaacactatgatatgatctctgcaggagcttttgcaggaattgtcttacttataatgtgtccgtacaggatctatgatacgggttttttatattcatttacagcagtttttgtgatcgcaatctatcaacttgttaaaccaaagatgaaaggtaaatattataagttgaaggaatctttatcgttttgtatttttatccagatagggatgctgccattgatcatatattttcaatatgaagctccagctttttcttttcttgcgaatgtagcagcagtaccactggcaacgtgtgcttttactttagcttttcttttgatttttttgccgtataccgtatttcatgaagcaatctcatggatgatccaaggggttttgtggatttccagacagtcttatgggatgttgacgatcggacatgtaccatttttatgggtactcttattttattttatgaccggattgtggatatggaagaaaaatggacaaaatcgacatatcaggatcagtctggcttatgttatcatgatcattttgatatggattccaatggcaagaagaaagagtctggcatttcttgatgttgggcagggagattgttttgtagcagatacgaagtctggggcgatcatatttgatggtggaagcagcagtgaagatcaggttggaagatatcggattcttccgtatatgaaatatctggggtatcagaagattcagattgcggtgatcagtcatatggatatcgatcattattctgggatcaaggaattacttgagatggggaaaattaagtatcttgggcttccagagattccaaaagatgagacaatgaaaaagatcataggtatagcgaagaaacgaggaacaactattttttatctttcaagaggaaggcagatcactacaaaagatggaagtttgaaagtgttgcatcctcaaaagaacagtcagatggaaaagaatgcggcatcgttggtaatgcagggaaaaatacttggatatcgggtgctgttaacgggagatgtggaaaaagaaggcgaagaagaactattatcagaagaattggaaagagcagatatattaaaagcagcacatcatgggtcaaaaaattccacgagtaatgaatttttacaaaaggttcagccgaaacagacggtcatctcttgtggaaaacaaaatagatatggacacccacatttagaaactatccacagactacagacatatcgcacaaagatttatagaacagatcgaagtggtgcgattatttttttcaaaagaagagatggttgaaaatcttcaaaaaaaaaggtatactatcaaaagctatagaaagagatgcaaagaatatgaagaaaatattagaagatatcaagacaaatacatacgaacgtttttatctattctacggggaagaaaaatatatgatctcccagatgaaaaaccagttaaagaaagcattagtttcagaagatgatacgatgaactattcttattttgaaggaaaaagggctgatgcgatagagattgttgaacttgctaaaacactgccgttttttagtgatcataggtttttgatcttggatgaaacaggacttggaaagaaaagtgatgatacgtttattgaaggattaaaggaagcctcggatacaagtgttgtgctttttatagaagatagtgtagataagcgttcaaagatttataaatttctttcgaaggaaggacatgcggtatgttttgaatctgctggagataaagaattatccagatggctgatctcattgcttaagaaagaaggaaaacagatgtcatctgcaacgatgcgaagttttttatatcgctgtggatctgatatgtatactttaaaaaatgaattagagaaattgatctcctatgttggagagagagaagaaattacgatccgtgatctggaagagttgacatcttctcagacgacaaatcagatctttgtgatgcttgaggcaattgcgagaaagcaaagagaaaaagtattgacactatattatgatctgatcgagttaaaggaatcaccatttggaattctggcattgttagtcagacagtgtaatcagctgcttcaggtgaaagatttagattgtcttggaaagagcaatgggatgatcgcaaagcagatgaaagttccagcatttgttgcaggaaagttaaaagatcaagcgaaaatgttttcaatggatacactcagagatatgatcgaagcatgtgcaaaaactgatgaatcaattaaaacaggaaagatcagcgacagagttggggtagaactattgttgatccagttcagtcagaaataaatcaatcaatttaagatagaagaagtctagtataataaaaatgatgaaaaaaagaagcctgacggtggcttctttttttcgggttaattttattaaaattcgtttcttgatatctgattaagcaatagcgttaacggctttagataaacgagcaatctttctagaagctgtattcttgtggaagattcctttagaagtagctttgctgatttcagaaatgcaagctgttaaagcttcagaagctgctgctttatcgttagctgcgatcgctgcttctacttttttgatatatgttttaactttagttttgattgctttatttctttctgtttttgtgttgataactttgattcttttttttgctgatttaatatttgccaaagtgggcacctccaatatgataacttaaatttctttcttttcttgaatcttgtctatagcgagacacggttagctatacacaaaacatactgttatatcttatagaaaatgattgaatttgtcaatatctttggggaaaaaatgtaatatttttttaaaaacaatcacatactagagaaaaaaggaggcaaaatcaatgcaaaatcgtacagatctggcactggaattaaaagaagagaagaatattggctctgcacagtcaggaattatcgtaaagacaagaattgatacaacgaatcatataaaagaaacaaagatcatcatcaaaaacaaaaaaggggaggactctttaggaaaaccaaagggaacctatattacgatcgaagcgaaagatctgtcgacaaacgatggtagttttcataaagaaatgagtgaagcattatttttaaatttaaaggaaatgttaaacaaaaagaaaaaaatactgatcgcaggacttggaaatgctggtgtgacagcggattcattagggcctaaagttgtgaacaatctatatattacaagacatttgcaaaaagaggggattggaaattatcaatttgaactaagtgcgatcgcaccgggggttatggcacagacgggaattgagacaagtgagattttagaatcattagcagaccggataaaaccagatgttgttatcgtgatcgatgctctggcggccagaagttatagcagattaaataaaacgattcagatcagcgatacgggaattgcaccgggttcaggtgttggaaaccataggaatgagattacacagcatacgatcggtgttccagttcttgcaattggtgttccaacggtaatttctgttccagcgatcattcatgatgtttttggagaaaaatctctggaaaatgtttctgaaaatattgatgaagaatttatttccatgcatgttacaccaaaaaatattgatgaatctatgaaacggatcagttatacgatatctgaaggaatcaatcatttactgcataattaaaatatgaatgaatacaatgaaagtatggagaaaagaaagagatggatattgagtattatgatcggttgttttctgatcatttttttcagtcagaagatcaatgcgcagggaatggttttagaattcatggatcattattatcatgggatcatgacaggattttttccggcagtatctaagaaggaaatgacattttcgggaaatattctatcggacatggtccgtatgtattatcaggaaacagtaccaatcttacaatatcgcacagattataaggataaaaaagaagaagatctggtacagcaagattattattttcaggatgatgaaacaacggatgaggtggtagaggaggtaaaaaaagaagaaaagttgtttcatgcaaaaaaatgggaaaattcaaaatatttaagaaaatatatttatcagatcgacagtacgacaatggcgacagagaatgagttaaatggaaaagttttattaaacacgaacttaaaattaaggaaatctgatgaaccgcagattttaatttatcatacacatgggagtgaggcataccgtggcagcaggaaaggaagaaaatcagatactgtgatcggtgttggagatgttttaacgaagagattggagcaaaaaaatatcaaggttgtacatgatcgtaacatttacgatgtaaaaaacggaaaagaggagcgatccaaggcttataattatgcagcaactgcaattgaaaagaatctaaaaaaatatccatccattcaggttgtgatcgatctgcacagggatggagtcaatgaatcgacaaagcttgtgacgagacaaaatggaaagagaatggcgcagatcatgttttttaatggaatgagccgtacagcaacaaatggaaatatcaaatatttaaagaatccaaataagcagacaaatcttgcgttcagcctgcaattgcaagcacaggctgctttgaaataccctggatttacacgaaaaatttacgtaaaaggatatcgttataatctgcactacagaggaagaagcttattagtggaagttggtgcgcagaataatacgttatcagaagcaaaagcgtctatgagtttacttgctgaattattaaataatgtgttatactaaaatggagtgtctgaaaagacatatgtacttgaaatataattaggaggaacttatggcaatagatcagagtaaaatacgaaatttttgtattatcgcacatatagatcacggaaaatcaacattagcagatcgaatcattcagatgacaggaacattaacggatcgagagatgcaggagcaggttcttgataacatggatcttgaaagagaacgtgggattacgatcaaatcgcaggcagtacgaattgtttataaagctgacgatggggaagaatatatttttaacttgatcgatacaccgggacacgtggactttaattatgaagtatcacgaagtcttgcagcatgtgagggagcaatccttgttgtcgatgctgcacagggaatagaggcacagacattggcaaatgtttatcttgcgattgatcacgacttagaagttatgccggttatcaacaagatcgatcttccgagtgcagatccagagcgtgttaaagcagaaattgaagatgtgatcggaatcgatgcagaagatgcacctcagatttctgcaaaaagcggactaaatgtagaacaggtattaaagcagatcgtagagaagattccatcaccagagggcgataagaatgcaccattacaaggattgatctttgacagtatgtatgatgcatataaaggagttatcatctttacaaggatcaaagaaggaacgatcaaagtcggaacaaagatgaagatgatggcaactggagagagtgcagaagttgtagaagttggtacatttggggcaggaagattcaatccatgtgatgaactgacagcagggatggttggatatgttacagccagccttaaaaatgtacagggaaccagagttggtgatacgattacagatgcagatgatccatgtgctgaaccacttccaggatacaaaaaagtaaatcctatggtatattgtggactatatccaacagatggagcaaaatatccggatttaagagatgcattagaaaaattacagttaaatgatgcagcactacaatttgaagcagagacatccgttgcgttaggatttgggtttagatgtggatttcttggattattgcatttagagatcattcaggaacgtttggagagagaatataacttggatcttgtaacaacagcaccaggcgttatttatcgcgtatataagacggatggaagtatgatcgaattaacgaatccttccaatcttccagatccatccgagatcgaccatatggaagaaccgatcgtaacagcagagatcatggtaacttctgagtttgttggagcgatcatgggattatgccaggaaagacgaggcgtatatcttggaatggagtatatggaagagacaagggcattacttcgttatgaacttccattaaatgaaatcatttatgatttctttgatgcattaaaatcacgttccagaggttatgcatccttagattacgaaatgaaaggatatcagacatcaagacttgtaaaattagacattttgatcaacaaagaagaagttgatgcgctttcttttattgtacatgaagataccgcgtatgagcgtggacgtaagatgtgtacaaaattaaaagaagaaattccaagacatatgtttgaagtaccgattcaggcagcgattggaagtaaagtcattgcaagagaaactgtcaaagcaatgagaaaagacgttcttgccaaatgttacggtggagatatctcccgtaagagaaagctgttagagaaacagaagaaaggaaagaaacgaatgcgtcaggtaggaaatgttgaaattccacaggaagcattcatgagtgttctgaagttagatgaagactaatacgatcgagctttatattcatattccattttgtaaaagtaagtgcagatattgtgatttctgttcctttcgggcagaggaggaaacgatccatgcatacctggggaaactaaaagaagaactgattttctggggaaagaaattagcggcacgagacgttgtaaccgtctttattggaggcggaacgccatcatatcttagaagagaagatattcaaatgatttgtgaaactatatttgaacattttcatatttgtgaggatgctgagattacgattgaagcgaatccaggaacagtagatttaaaaaaactatgtacatatagggaaaatgggatcaacaggatcagttttggattgcagtcaacagtgaaagaagagttggagtatctgggaagaattcatacctatgaagaatttttacaaagtttcgattgggcaagacaagctggatttttgaacatcaatgttgacttgatgagtgcggtgccgaaacaaacattaacttcttatgaagagaatttaagaaaaatagctaaactttctccagaacatatttctgcgtatagtctgatcattgaagagggaacacctttttacgaagataacaagttagaggaacttcttccatcagaagaagatgaagttttaatgtatcgaatgacagaaaagattttaaacgaatatggttacgacaaatatgagatttcaaattatgcaaagccaggttttgaaagcagacataatcttgggtattggtcccatattccttatttgggagtggggcttaatgcctcttcgtatctggatgagaaacgttttgagaatccctccgatatgaaagactatttagagattcaatcgttcggagatgcatatgaaggagcccgttcgttatcagtttatgaacagatggaagaatttatgtttcttggacttcgaaagacgaaaggcatttcgaagaaagagtttatagaacgttttggttgctccatggattctgtctatggaaagccattgatagaatccatgaaacaaggcatgatgaaagaagaaggagaccgagtttttctgacgcaagatggtaccttagtcagtaatcaggtcttatgtgaatttttatttgacgaggaagtttaaggatacaagtttatcaaagatccattaatttctttagattgatctgcccccagccctgatggtgtctgggggtttttaatttgtcgcagttttttcgcagtttcatttttatatccttattggtgtaaaaaggatatttttcgagcaggagagcaaaagaaccagagacgacaggggttgccatggaagtaccacttttgatagtatagcggttatttaaggaacacgaaaaaatatttgttccaggggcaacaacatccggcttcataacgcaggatgttgtgggaccgcgtccggaatatcctgaagagaagtgttttcttccgatcatttgaaaattatcgtcgctggaaccaacagtgatgatttttggactatttccaggaattgaaatactgtatggttttggaccatggtttccgccggcaatacaaacaacaaggccatcatcccatagggcgttgacatgttttaatagttctttggaggctgaactatcctcggaaccaggacttcctattgagatgttaacgatacggatctgataggagcgatgatactcatgaatccagtcaagaccctgtaagaaggcgctttgaacaccgttccctgaggcatccagtacttttaaagaaacgatatgggattttggagcaattcccaaataatcggaaccaaatgttgcagaggaagcagcgatgccggtaatatgagtcccatgtccattatcgtcatagctgaaagatttggaatgaacaaaatctacaaatttggcgatccgtgtggaatgcggagagaaatctttatgtgggaaaaggccagtatcaagataagcaataccgataccttctccaagaaaaccatgctgatgggcaagatcagcatggatttgttttgaaacagaaatctgcatggaaagttgcctttcatactttatattattagaatacgcagaataaaagatgaggggaacaagaaaaaggccctctgcaggaccttttaatgtaaaaatatttagttaaatccgataaatctacgagctgctttatacatagcaatcgtagcttttcttccaacatatccaggcagatttactgcacagcttgtaatattatgacggatcttacgatacagacgtttgtcactgtcatataaatatttccataattcttttcgcatctttaaatgctctttctgtccagattttacagagatcacggaagaaatacacatgataatggaaagataatgtctcatataacgttctaatggcttacttacaagattaaactgagtcatataatcaatcatgatataagtaactttaaactgctggtcgatacgtttgatcatatttgtctcattgacagactgatcatcacgtccaatgaaataacgatagaagttaacatccagataatacattgtttttacatatggaagaggtttgaatacataaatattatccacatagaatgtatgctctggaagctctagatcgcattcacgaagcagtgcagtacgataaatgacagagtgcattaaaatatactggctgacaggaaaacgtccaacatcatcccagcaaaagatctgatcttttgggattgcatgacgataatgaataacagtttttttcttggctccctgtttttcatatacatagttagaaagcagcatatcaaggacagttccctgtttgtagaaattcgcaagagtatcaaggatttctccataagcatattcatttacccagtcatcactatcaacaactttcaggtaaatacccgtggcatttttgattcctgtattcactgcaccaccatgccctttattttcctggtgaattgcacggcagatgtcaggatattttttttcatattcatctgcgatcgcagcagtgttatcggaagatccgtcattaacgatcagaatctctacctgatcaccacctggtaataaggtgtcaatgcagtgtctcatatattcctgagagttgtagcaaggtacaacaaaggatattaatttcataaaaacctcctgtttttcaatacggttaacgttactattatatatgtttttttacaaattagcaaagagtttcccattcttcataaagttcttccaaagaagaagcgatggaagcctgctcattgctaagttccattaatttcgcaggatcagaagcattttcaggtaaagacatagcttctgaaagttcttcttgtttcgtttccaactctgtgatctgctcttcgacttttttaagacgattttctttttttctctgtttggcttgttcttctttttgttgtttccaatcgagtttggattctgtatcaacagaaacggaggaagcagtagaagaagtaagagatgccttttctttttccttctgagcaatataatcctgataatttccaggataagaagttaatccatgatcagagatttccaagattcgtgttgcagttttattgataaaataacgatcatgtgaaacataaaggatcgttccagtataagcattcattgcagattccagaatctccttagactgaatatctaaatggtttgtaggctcatcaagaatcagaaaattcgcatgagacagcattaattttgcaagagaaacacgtcctttttctccaccgcttaaagaggaaatcgggcggaaaacgtcttctccataaaataaaaatgcagccaaagtattgcggatctttgtgttattaagatctggataagcatctgaaatttcatcaaaaatcgttttggaatcatctaagttatcttgtgcctggtcatagtatccaatggaaactccagctccaaggctgatcgtaccgccattattgctgatctttttgcaaatgatctttaacagtgttgttttaccagttccgtttggtccgatcagggcaacgcgttcttcacgaaaaatatcagcacttaatccatggaataatgatttgtttccaaaagatttggatacatcttttaaagtcagaacatcattcccactgatgatctctggttcaatgctaagacgcatatcagcattatattccgtaggtttctccaatacatcaatcttatttaaagctttttcacggctttctgcccgtttgattgatttttcacgattgaactgttttaattttttgataacttcttgttgatgtttgatctcttgttgctgatttttgtattcttttaaacggattgctttgatctgatcacgtttttcgataaatgttgtataatttccatcaaacagcatggagtgtccttggtcgatctccatgaccttattgacaatcttatcaagaaaatagcggtcatgagatacgatgatcacagctcctttgtaatgagacaggtaattttcaagccaccttatggaatcaacatccaagtggtttgttggttcgtcaagaagcagaatatcaggatttttaagcagtaacttaccaagagcaacacgagttctttgacctccagataaagtgttgatctcttttgtgaaatcttcttcagaaaagccaagtccttttaagattcctgtgatctcacttttgtatgcaaaaccatttaattgctcaaatctatgagtcgcatttgtatactggttcattttttgttctagtgcatcaccggtcagatgtttcatttcctgttcataggtacgcatctgttcatctaattcaatgacttcttttttgacggaaagaagttcatcaaaaattgtatggtggaatgtatgatcttgatgttgggcaagatagccaatgcttgcgtctttctttaaagaaatttcaccttcatcataagagatttcaccaatcaatatttttaaaagtgtcgattttccggcaccgttatatccgatgatcgccagccggtcgttttcatttaagtgaaatgagatattctgcaagactggtttttcgacaaatgttttgcagatattctggcatgataatatcattaagatacccctttcaaattttttattatagacattatttctcagaataccatattttttgaaaaaatgaaatattttcatgacggaaagattgacagttattagacaatcttatataattataagcgaaataaagattttggaggaataaaatggcaaactcagataagaatatttcctcagcagttatcaagcgacttcctaggtatttcagatatttaggagcgctaaaagcgaagaatattacaagaatctcttcaaaagaattaagtgaacagatgatggtaacagcatcgcagattcgtcaggaccttaacaattttggtggatttgggcagcagggatacggatataatgtagataatctgtatacagagattggtaagatcttaggtctggataagagaaatgacatgattattgttggagccggaaatcttggacaggcccttgcgaattatcagtcttttaatgaagattatggatacaaagtcatggcactttttgatgtgaatccaaagctgatcggaatttctgtccgtggagtgaaagttcttgatacagatgaactagagaactttatcaaaacacatggaattaagatcgctgcactgacaattccgaaggatcaggcacctgcgattgcaaagaagatggcagaatggggaattaaaggattctggaattttgcaccgatcgatcttcatttaccagataatgttacagtagagaatgtacatttagcagaaagtctgatgacattaacatacaatgtccacaaccgtgaagagagtgagaacgaatagcaggtaagaagatgattgctggaataggaacagatctcgtagagatataccggatagaagagatgattcttcgaggaagacatctttcaagaatttttacgacaactgaattagcatatgcaaaagacaatgctacgactttagctggcaattttgctgtaaaagaagccgtttccaaagtatttggaaccggctttttcggtgtggaaccatatgagattgaagtgttgagaaatgaatcaggtgcgccatatgtcaaattatatggaaaggcgaaagagatagcaaaagataaacaagtttcaagaattcatgtatcgatcacgaatacaagagaatttgcacaagcttttgcgataggggaatgcgtatgagatatgtattaaagaatcaggagatgcaaacggtcgatcatgagacgattcatggaataggaattccgggacttgtattgatggaaagagcatctaaagcagttgcagataaggctgcacagatagcagatcattcacagaggatattgatcatttcaggaattggcaataatggaggagatgcacttgcttgtacgagaattttgttggagcaggattatttagtggattatatgatcgttggtaatatagaaaaagcttcagcagatctgaaattacagcttcagatacttaagaatctaggctattttccgatagattgtgaagatgtaaattttcatgaatatgatcttttgatcgaagggatttttggagttggactttctagagaagttggtggtgtttataaagaagtcattgaacggatcaatgcatgtggtaagcctgtgatcgcaattgatattccatctggaatcagtggagatagtggaaagattcttggatgtgcagtgcatgcgtcatcaacagttacatttggtggatataaaagaggtcatttattatatccaggacgagaatattgtggagatattaaactggtatccataggatttcatgaccagacgatcaaaaagtatgcgacaggatatatattagaggaaagtgatcatttaatgccagaaagaaaagcatattccaataaaggaagctatgggaagattttgatcattgctggaaatgaaacaatgtcaggagctgcatgttttgcagcagaggcagcacttcggatgggtgcaggacttgtgaaagtgctttctgatgctggaaatcgtcagattttacagacaagacttccagaaattttatttggagaacgaaaagatttagaagaatctttagaatggtgtgattgtatcttgtttggcccaggagttggtgtcagtgaagaaatgaaagaaatgttagagatggttttgaaaaaaggaaaaaaaccattggtcattgatgcagacggattaaatataatcagtagatttaacatgaaaattgattatccatatgggacgatcatgactccacatttgatggaggcagcaagattgatgtcatgtgatatcacacagatcaaagaagatctatgtcagagtgcacaagatcttgcagagaaatatcattgtacagctgttttaaaagatgcaacaactatcgttgcacgagaagatgatttggtgtatattaatcaaagcggaaatgatggaatggcgactggaggaagtggagatgttcttgcgggaatgatcacaggccttttgggggaaggattatctgttcatgaggcagcagttcacggagtttatcttcacggtcttgcaggagatcatgcaaagcatgatctgggcgcttacagcatgatcgcatcagatattattgctcatataaaggacgttacaggaggaaattatgaaccagtactatagagtgcatgcagttattgatctggatgcaatctgtcataatataagagaagtaaaacgtgtagttggagaaggtgtgaaagtaatgccagtgatcaaagctgacggatacggacacggagcagttccaattgcaaaagaattaaataagatcggagttgatgcatttgccgttgcaatcctagaagaagggatcacacttcgaaacaatggaatcagacagccaattttgattttaggatacacatcagaatatcagtacagctcattgattcagtatgagatcgagccaaccgtattctgctatgagatggcagagtccttatcaaagatcgcgcaggcactaggcaaagatgcgaagattcatatcaaactggatacaggaatgaaccgtatcggatttaaaccaaccaaagaatctgtagatagcatagagaagatcgccaaattaccaaatatcaagattcaaggaatctttacacatttcgcatgtgcagacgaggcggataaaacagaaacttatgagcaggaacgaaaatatgatcagtttattacgtggcttgaggaaagagatatctatattccgatcaaacacgtatcaaacagtgcatcgatcattgatctggatggatttagaaaagatatggtacgttcaggaatcattacttatggattatatccatcagaagaagtttcaaaagatgtattggatttaagaccagcaatggaattaaagacacacattgtatatatcaaagaagtggaagcaggagaaggaatcagttacaatcacacatatgtaactgataagaagacaaagatcgcaactatcccagtaggatatgcagacggatacccaagatcactctcttccaaaggaaaagtattgatccgtgggcagtatgcaccgatcattggaagaatctgtatggatcagtttatggttgacgtgacagatattgaaggtgtatctgtgatggatgaagtaactttagtcggacacgatggcaataaaatgttgaccgtagaagaagttgcaaatgaagcaggatcttttaattatgaatttgtctgtgggattgggaaacgtgttccacgagtatacattcgaaacggagagatgaaagaaacagaatattttgaaaaataaggaatacttttgaaagaatcgtaaatactcttcatacaatatttaaaaagaaatggagagtgtttatgcttatggtaattaagcgaggcgatatattttatgcagatttaagaccggttgttggttcagaacaaggcggtatccgtcctgtgatcgtattgcaaaatgatgcgggaaataaatatagtccaacgatcatctgtgcagcgatcacaagtaagatgaacaaggcaaagttgccgactcatgtaccgatcgactgccacagatgtgaattagaaaaagattctgtgattttgttagaacagatccggacaatcgataaaagtcgtttaagagaaaaggtatgccatttaaattgtacattcctaaaacaagtggatcatgcactaaagatcagtttaagtcttgatacataacaggaatcttggatatattgaccttttttcttagaaatgatatatttaagtttgtatagtcttaatttctagaagataaaaggagaaagaaaaagaaatggaaggatttactccctcggtgcttatgatgatcattttagcagttatcatcggatttgcagttgggtgttttttcatgaaacaaagagagaagatcaaagaagcaaagaaaaaactgcacacatcagaacaagaacatgaagaggatgaagacaatgaatatgaagaagagatcatgaacattgttaacgaaggacatgagcaaggtgcgatcatggaaggggaagcccgcatgatcacgaatattttcgaatttggagataaagatgttacagatgttatgacatcaagaaagaagattgatgcgattgatgtaaacatgtccgtagagaaagcattaaattatatgttagatgagccatattcaagatacccattatatgaagatgacattgataacattgtaggaatgctttatttaaaagatgtgatcgatgcatatcttaatcagaaagaagcaacactttctgatattgcaagagagccgttttttgttcatcagacgatgaatttatcggtgctttttcaggagatgcagaccaagaagattcatatggcgatcgttattgatgaatacagccagacagaaggtattgtatctatggaagatatgctagaggtcatagtagggaatattttagacgaatatgatgtcgaagaccgtaatatcaccaagattggatgggcagatatttatcttgtacgaggaagtacgagactggaagaacttgaggatacattaggaatcgaatttgacgttgaagatattgagacactcaatggatttttaattgatcagctgggacatttaccagaagacaatgaagaaatagaaattatctaccaaggatattcctttaaatctgttgatattcatgacaacatgattagacaggtaaaggtagaaaaaaggaaaaggaaggaagaagaagatgtcaggacacagtaaatttgcgaacatcaaacacaaaaaagaaaaaaatgatgcgaaaaaaggaaagattttcacagtcattggaagagaaattgcagtagccgttaaagagggtggaccagatccagacaacaatagcagattacgtgatgtcattgcaaaagcaaaagcaaacaatatgccaaatgacacgatcgaacgtggtatcaaaaaagctgccggagatgcagattctgttaattatgagcagattacatatgaaggatatggaccaagcggagttgcgatcatcgtagatacattaacagataacaaaaaccgtacagcatctaatgtaagaaatgctttcacaaaaggaaatggtaacgtaggaacaccaggatgtgtatcttatatgttcgagaagaaaggacagatcatcatctctaaagaagaatgtgaaatggatgcagacgatcttatgatgatggcattagatgccggagcagaagacttcaacgaagaagacgacagctttgaagtattgacaacaccagaagacttcagtgcagtcagagaagctttagagaaggaagaaattcctatggcagatgccagtgtaacaatgattcctggtactatggttgaacttacaagtgaagaagatattaagagtattcagaaaacattagatcttcttgatgaggatgacgatgtgcaagaagtgtatactaactgggatgaataatctgttatagattttatagaatataaaataataagaaccttaactcaatgcatatataataaatgctgggagttaaggttcttttttgctatgatatttgaaatttataatatgaattattactgttactaagtaatcttcgaacacctataaaactatgcattctcaagtgcttctttcagatcattgataatatcttttgcactttcaattccaacggataaacggatcattccaggagaaacaccagcttctcttaactgttcatcattcatctggcgatgtgtatgacttgctgggtgaagaaccattgtttttgatgcagcaacatgagttgcgatgttcgctaattttaagccatccataaagcgtactgcagcatcacgtccaccagtcagttcaaaggaaataacaccacaggttcttcccttatccatatatttttgtgctaattcgtgatatttatcattaggaagtccggcataaataacatgagatactttttcatgagcatctaagaattcagcgactttctgagcattttcacaatgacgttctacacgtaaaggcagtgtttctaatccaagatttaataagaaacagttttcaggggatggaatggaaccgaggtcacgcatcagctgtgttgtagcttttgtgatataagctttctttccaaattgttttgtataaacgacaccatggtaagattcatcaggttcagtaagaccatgatatttgtgtccataagcgtcccagtcaaagtgtccgctgtcaatgatcgcaccgccaacttgaacggcgtgtccatccatatattttgttgttgaatgtgtgacgatgtcagcaccccattcaaaaggacgacagttgatcggtgttgcaaaagtattatcaacgatcaatggaacttcatgttcatgggcaacctttgcaaatttctcaatatcaagaatgacaagtgcagggtttgcaattgtctctgcaaataaaactttggtattcggtttgaatgcagcagcaatttcttcagcacttgcatcagtatcaacgaatgtacagtcaattccaagtttctttaatgtaacacccagaaggttaaatgttccaccatagatcgtagaagctgcaacaacatgatctccagcttcacagatattaaagatcgcatagaagtttgcagcctgtccagaagaagtaagaagtcctgcaacacctccttcaagatcagcaattttggcagctacagcatcgttcgtaggattctgaagacgcgtatagaaatatccttctgctttcagattaaataactgtcccatttcatcggttgtatcatatttgaaagtagtactctgataaataggaagtgcacatggttctcctttcttaggagtgtaaccagaatgaagacattttgtttctaaatcataatgactcataatcataattcctttctgttataaaaaatatgtattaaattatacccgtaattcctaaagaaaacaaggggaatagaattcagataatttattgaattgactaaaaaaaaagaaaattcgagattttttatataaaagaaaaacaacttgacaaaaaaattatttttatcacacaaaccaacaaaaacattgaaaaacttaacgaagttcttaagataatttgttgttttatttttaacgatgtgctaaaataaagatgttatttttaatactgaaaggagtttcaacatgatttattcacatgaagtagaacaaatgtgtacagtagctcagggtgtaaaccatggagctgccccaattcctgaagaagcaaaatgggtaaaagcgaaagatgtaacagacatctcaggattaacacatggtattggttggtgtgcacctcagcagggaggatgtaaattaactcttaacgttaaagaaggtatcatccaggaagcattagtagaaacaatcggatgttcaggaatgacacattcagctgctatggcatctgaaatcttaccaggaagaacaattttagaagcattgaatacagacttagtttgtgatgctatcaatacagcaatgagagaattattcttacagatcgtatacggaagaactcagagtgcattctctgaagaaggacttccaatcggtgctggtcttgaagacttaggtaaaggattaagatctcaggttggtacaatgtacggaacacttaaaaaaggtcctcgttaccttgaaatggctgaaggatacgttacaggtatcgctcttgatgctgatgatgaaatcattggataccagtttgttaactttggtagaatgatggacttcatcaaagctggagacgatgctcagacagcacttgacaaggccaaaggtcagtacggacgcgttgatgacgctgttaagattattgacccaagaaaggaataggaggtagcgaataatggctttatttgaatcatatgaaagaagagaaaaacagattcttgctgttttaaaagagtatggaatcaattctatcgaagaagctgctgaaatcacaaaagctgctggattagatgtttatgctcaggttgaaggaattcagccaatctgtttcgaaaatgcaaaatgggcttacacagtaggtgctgctatcgcaatcaaaaaaggttgcaagagagctgcagacgctgctgctgctatcggagaaggtcttcaggcattctgtattcctggatctgtagctgatcagcgtaaagtaggtcttggacatggtaacttaggaaagatgcttcttgaagaagaaacagaatgtttcgcattcttagcaggtcacgaatctttcgcagctgctgaaggagctatcggaatcgctgaaaaagcaaacaaagttcgtcagaaacctttaagagttatcttaaacggattaggaaaagatgctgcacagatcatttccagaattaacggatttacatatgttgaaactgaaatggattattacacaggtgaagttaaagaagtattcagaaaatcttactctgaaggattaagagctaaggttaactgctacggtgctaacgatgtaacagaaggtgttgcaatcatgcacaaagaaggtgtagacgtatctatcacaggtaactctacaaacccaactcgtttccagcacccagttgcaggtacatacaaaaaagaatgtatcgaacaaggtaaaaaatacttctctgtagcttctggtggtggtacaggacgtacattacatccagataacatggctgcaggaccagcttcttacggaatgacagatactatgggacgtatgcatagtgatgctcagttcgcaggatcttcttcagtaccagcccatgtagaaatgatgggattaatcggtatgggtaacaacccaatggtaggagctacagtagcagtagctgtatccattgaagaagctgctaaagcaggtaaattctaagaaaccgcttaaatacgtggtttttaggaacgataaaagtggtaaaaagcaatgaaaagtgactcgttgctacaacattgctacaacattactacaactcgttgctacaagtgaataaacaaaaagagtcaagaatgtatatcatatcttggctcttttttgtgcttaaattatttaattttcaatatctcttccatcagccattctctttttcgcttcgtataagtattttctgtaatgtcttttattttatgtcccatgatacgtttcacagcatattcattgacctcggcagctttcgccattgttgcgaattggatacgaccatcatgagcacgatgatctggatttaactctagttgttcaataatcttatcaatcctgtgccggtatttgtcatatgtaagtttcaaactagatcgatgagttttagtgtcagtgcaattgatcaagtattcgcttcctaatttttgagcttcctggtaacggtgctttaccaaactccgaatctttggatgaatcggaactacacgattttttccggcatcggttttcatacctccagtaataaaccaattctctaaatcaacattctccatttttaacaagcctaattcctgtggtcgccaaccggagtagcactggatcagcaatacatccacataatcaacattatataagttattccatgatttcagcatttcctcatctgtgaagtcgatatgatctttcttttcttcctcgacgtccttaataatattatcggataatttgaaagttcgtgcatagtttttgtcaacaacatcattttcatttgcataatcaagcattaaattgaacagggacttgatttttgttttggtggtaggagaaggatgtttttcttttccatcgacttcgtatgtaccttcttccatacagcctttaatgtgtcgcggacgtaaatctttggcacgcattttgtaaatggaagagcagtagttccaagctgatttgatcgttctttcgctagatggattggataaagtcttaaagtattcctcagtccatttttcatacagctcttcaacagtcagatcgtcatctaaatcgtaaggatttttattgtattcgactaatgcagcataagcctcattataagtcttgaagaatgcaacgggtttgagcagtttacgaattggtctgccgtaaaagtcttttccaacagtaaccattgcacggaaaggtttgtatagattaccagttttgatttcagatatctggccaaagccatttggaagtttttttcgtcttcgctgtttggttcgttgctttttggcagcagttgtttgtagaggatatccgcagtgaggacaagcaattgcatgatcgcttacctgcagattacattcgggacatttaattaacatgatcatcattcctcgtattatatagtagtagtgtttagagaccctctccaaggtctttattactattaagtcatagtcttttctttaccttttctacaggttcgactatgatatttaagatgctgtggattggttcatttttcctaccacttgatggtttacgaaaggctccaaccacagtctctttgttcatttgttaatcagttagataccgcatgacggtttatttagaacgaggttacaatcacaaggagcaccctgtggttctaaaacagcattcatatatttcaaaggagattttttatgatttacgtaggaattgatgttgcaaaagataagcatgactgctttatcactaactttgatggagaagtgttatttaaagcatttaccattgctaacaacctggatggtttcaatgatctttatcaaaagattgtatccgttgcggaagatatagccaaagtaaaagtaggactggaagccaccggacactatagttacaatctcttaggatatctcattgataaaagtttgcccacctatgttatcaatccgttacatactaatctgtacagaaaaagtctaagccttagacagacgaaaacggataaagtagatgcccgtacgattgcttctatgctaatgtctgacgtgaacttaaagtcctactcagacatatcttatcacaacgaagaactaaagtcattaacccgttaccgttttgataaagtaaaagaacgtgctaagttaaagtcttccgtttcaagacttgtctgtatcttatttcctgaattagaaaagttagttccaacacttcatatggcatcagtttacgcaatgctttctgaatttcccggtgctaaacaagtagcagacgctcatcttaccagacttaccaatctgctttctgaatcatcaaaggggcgatatggtaaagaaacagctattgcttttagaaatgctgcaagaacctcaataggttcaaatatgccagcaaaatcattagaattaaagcataccatcaagctgatccgggaactcacatctgatattgatgaaattgaacatgaaatcaaactcattatggatgaaatcaattctccgattcttagcatccccggaatcaattaccgtatgggagctatgaacattgccgaaatcggcgatttcaaccgttttgattctcctgataaaatcttggcttatgccggattatctccttctacataccagtcaggacaacttgatggcgcatactcccacatggaaaagcgtggttccagatatctacgatatgccttatacaatgcagccaaatatgtctgtcactgggatccaacattcgctgaatatctggcaaagaaacgagccgaaggcaaacattacaatgttgccatatctcatgccgtcaaaaagttggttcgagttatttaccatctcgagaaaaccaaccagcaatacatcaaagctgcttaagtttttctaattcaatactcctttttttgagcaccagcaacgatgctctttttgtcatgcagttttcaaggttcaaagaactctaactgagttcaagatatatctaaaatacatttctgtactttattcaaaaaagttcatttttagacttgacttttaatagttagtctttcgatatcaggagattgttgcagatgcaggatatgaaagtgaagagaattatctgtttttagagaaaaatgggcagtcatcttttatcaaacccatgaattatgagatttcaaaaacacgaaaatataaaaaagatatcgggaaaatggaaaacatggaatatgatcctgaaaaagacagttatcgttgtcaaaacaggaaaatgctaacagtccaatatcagagaaaacaaaagacagcaactggatatctccggacggtgactgtttatcaatgccatgaatgtaaaggatgtccgttcaaagaaaagtgtatcaaggggaataactgtaagactccgatggaaaaaagagaaaaaagactctatgtatcaaaagtgatgaaacaaaaacgggaagaaaatgtaaaaaggatcatcagcgaatatggtaaccaattgaggatgaaccgaagtatacaggcagaaggctcatttgcgaacgtaaaagaagatatgaattttcgaagatatctttatagggggaaagaaaatgtgactgcacaaagtgtgatccttgcaatcggatataatataaataagctacatcataagatacagaatggccgaacaggacaacatctgtttgcgttaaagaaataagaatttttgaaagttcaaaatataattgctatttttcttctaaatatttagaaggtatattaaagtacgctatttttaaatttttataagtataatgattagcgtttgttaaaaaacgttaaaaagatgctgccgcatctatgatttatttaatcaattaatgcgacagccccaacttgataaaaatatcgtaaataagtatgggactacttcttattttggctctgcatattagttgtagatttatgtgttggtaattcctttatttttagaataatatcgtctgccttaatgtaccagtcaacgtctgctccttgaaaagtagcggttgccaccgtatcagccacaggattgatgatttccacctttgcgttgtagtcaaattcctttagcggaacagtggcaggaatacttacctgtatcatgcgtccttgttccttacacttcaaatcgtaggtacgttccttgatttcttcagaaaccgtaccgtcctcgttctggatatgtacctcacgacgcagagccgagaatttcaatacgccgaatgttttttccatgttaggaataacgtgttttaattccataatatacctcttttctttctatattttattgatagtgtcattctgctgtcgggataatatctgtctgcctgtggattatcaagggcaggcgttgtgctttgcacccttgacaatccccattcagaaagataagccatcatcaagcagaatttagccagattgtcagatatacgctgacttttttatgatgggcggtgaacgggacgttgctttcatcagccgatacctcccgtattagtcagctttctttttataaaatctcttgtaggctgcgaagataagaccagcactggaaattccaagcatagccaacagtgcagctaaaggtgtattgtcacctgtttttggagagctgccagctctgctaggtgtttctggcgtatcggattcctctggtgtgacaagggtttctggttgttccttgacggtcacggtctgtccctcgtcgtcaatgtccttatgttccgctaccttgataggcttgtctggattcgtcacgtcgtataattcctcaaaagtgacaagctccttgcctgcaagctcgcttgcattaaaagtaaattcaatctgaacctccatcttgctgtctgtcgctgtgaatgtaaagtcattttccacaggctttccatcaatcagtagctgtgcattttcagattttatcatctgccagcctttgagctggtactgtgtgcctgtttccagaccgtccaaagtaacagtatcgacgatagttacctttttgtcggcattgatggtcttttcaccagtcgccttgtcactggcagtcgtgtgcatagtgatgatacgctctgtgattgtcacagtctgtccgtcgtcctcaatatctttgtgttccgctatcttgatgggttcgtctggattcgtcacgtcatataattcctcaaaagtgacaagctccttgcctgcaagctcgctggcattgaaagtaaatgccatttcgattttcattttggaatcctttgtggtaaatgtgtaatcattttccacaggttttccgtcaacaagtagctgtgcgttttcagattttaccatctgccagcctttaagctggtactttgtaccttttttcagaccgtctaaagtaacggtatcaacgatagtcacacttttaccagcgacgattgatttttcacctgttgctttatcagcagcagttgtatggatagtgatttctggttcgtattcatctgtcagcgtacctaagtcaatcacggtcttatttcttgaaaccaccacatcaaaagcaggaatcagcgtcattcccttattggaatcgcagcgcaattcctcaatcgtataagtatcgtaaggcaaagcacctttgctgtcgtctggtgcggaagtaccgaaccagataccgtcctcgctggtcttgccctcgttggtattctgtgtatgggaaacccagtcagcagaagttgagaactgaccgtttgcgtccgtcacgataacatgactttcaccagtcgtcttgcttgtaatcctaaacggaacattcgcaagacgcttgtgtgtgccagcagcgattttcacgccctcaatgtcgccacgtttaatctggttgtaaatggaatgttcttcatctgttaaatcaacgattttcccattttccgtgattgcaaattcaaccgcttttgcaccgtctgtcaaatatccctctggtgcgctggtttcttctaaacggtattttccaaaaggtagggtatctgtatcagtcgcagcaataccgtcaatccctgtatggattgtctttacggtttcgtttttcttatatagcttgccatcaaccaagacagcattatcatttaaggaaatgattgcaaaggcagtatcttttaaagttgctccgccctgtgctttggtatctttggtttcaaagtcacgtttctggattttgacaccgccacggataaccttgtcagatacagaatactggttgctgccgcttaatactgcaagctcgccatcttctgtaatctgcgccacatacaagccttttatctgttctgaacttccagtagcctgcatatatgcgccctccaataagtaaccgtttggagcagacttttcttctaccgtgatagttcccagcggcaggcaaactgtaccgttttgtgtatagaaactatcgccagatactttataggaatcagctaaacgggtgatatagtggattgcattgtcgctgcctttttccgctttagtctttgtcgtccatgtgcgtgtcggctctgctggaagattatcttttgtataatatccgtcgtaatacttccagacaaactctgcaccctccaaactcgcattaccctgtgggtctgctttggaagtttccatatcaatcttgaaaagctcaatcaaggtatctgtgactttaggtgtatcgctcactttcaaggtagctgtttcaccagctttgaccgtaagagtatacacgttcttatctaactggaatcctttggaagctttggtttctttcacatagtatgtcgcagcttttagttccacagtttcagtgctgccactgttatctgtcgtaagtgtggcaagctgttctttgcagcttttatcagcgtagacaccataagtcgcaccagtgattgaatagcagtcgttagattctgtaatccctgtattactggaagatttctgaatcttgccatttccaacagccagctttgcgtaaaactgtcctaattcctgtccctcgccagagtagatataaccataacagtcataacgtcctttattttctttgacaaaggctttagtacctgcgaatacttcatcttgtatcgctttggggatttcatcataggcagctcgcacgttatcgcagccccagcctaaatgaacgctcaatctctgccagaccactaactgtcttaacaggtaggcgtgctgactgcttatccctttatgactgtctgtgtactgcttgacgtattcaatggataaagcaacgtcagctatctggtcggcactcatgcgtgtgcttgcgtcagctctggtcttatagccatttttgaaattcgtgtttatatctatgcagtaagcgtcctcgccctcgacggtcatatgcccctcgttgaatgttgagccgatagaaccgacattcattactttttcaacgattcctacacgttccgcagattctgtccagtattgcgtctgcgctgcatgaaccacagtagtaggtaatgtggtaaagacggttgcaagggtaaggacacccgtaaacaatcgtttcataatctttatcataattttttgattctcctttctttctgaaatataaaaaggacgctcatttctgaacgtccaaagggtacgagtatcttgatttctagtgacaaatgatttatatttaaaaaagtaaaaattgcaaaaaactaagcgcatttgctaacagcttgctaacactctacggtgtatggcagtacacctacgggtatcagcgtctagcaataacaaaggcttcgtctttattttttgccattaagcgccccataaaggataatcgaaccaccagctaccacagctcatagggaactcctaagagaaagccgaggcattccccaaagggaaaaaatgaaaaacaactttcagttcgaatctattctgaaaaatgccaaaggtgacaacaaatcattccccaaattggggaacgttctaatgttaccaaatcgaaaaaatctgtagattgacaactcaaaaaagagttgataatcttatatatggccgaagggaaaatcccagaaacccagtaaaatcaagggtttgcggcatgtatcgtcatagctcagctggatagagcactcgcctcctaagcgaggggtcggaggttcaaatcctcttgacgacggacttcaaagcgttcgaaaatgttagctggattagctgacaacgaacgcttttgttattttcaaatcacgttcgtgacacaaaattccattcaaaatgatcaatttccagctaacgcaatccgatttttgttagctgacagctaatcaaaattaccggtttgcaaacatgggttttaagaagtccagctaacatttgggttccgctccgttgtcaccccttatttggggatgtaaatcagagaaaaggcgggaaaagaaacaatctctcccaaacctgcaaacatgaattagctgaaacagtattcaattctattagctacagctaatggtcaaacagcaatgtctgtttggaactttactatctataaaagttccaggcaggcattttttattttctgaatcctggaggaaaggagtcaagatgactgagccaaacagataatcaggagaaaacgaagaaagaatcatagaaattgagattgagcgtcttcgtccattcaaagagcatccgtttcaggtgaaagatgataaggaaatgtttcttctacaggaaagcattgagaagtatggaatattaaatccgctgatcgtcagacctgtaccggatggctactatgagatcatatccggccacagaagaaaacatgctgcggagaaacttggataccgtaaagtaccggtaatcatccgggtattaagtgaagatgattccattttaagtatggtagattccaatcttcacagagaacggatcagttacagtgaaaaagcttttgcttacaaactgaagaatgatgtattgaaaagaaaaagtggtcgaaaaaagagccaagttgaccacaaaacaccaagaaagcgggcaatagaaatcatcagtgaagattgtggtgatagcccaaaacaagtgcagcgttatatctcactgacaaaactgataccggaaatgttgcagaaactggatgatgagattatttctttttgtccggctgtagagatagctgcattaagtgaaaaagaacaaagagaactgcttgtagcaatggagtatgcacaggcaatcccatcactctcacaggcccagaggatccggcaactgagtaaagaaaaacagttgtcactggaaaagatggaagagatcatgtgtgaagtgaaaaagggtgagatcacaagagtggcattcacaaacgagcagttgcacaagtattttccaaattcttatacaccggcaatgatgaaacgggaaatactggcactgttgaaattatggaaaaaagaatcatgggaaagttaaaggaggaagaaatcatgtgtaaagttatatccgtagtaaaccagaaaggtggcgtcggaaagaccaccacaaccgtaaatgtaggcattggactggcaagagaaggtaagaaagtgttgctgatcgacgcggatccacagggaagtttaaccgcaagtcttggatatgaggaaccggatgatcttcgcatcacattggcaacgatcatgatggatgtcatcaacgaagaagaaatctctctggaagatgggattttacatcaccaggaaaatgtagatcttctcccggcaaatattgagctttccgcactggaagtaacgatgggaaatgttatgagcagagaaatgatcatgaaagaatatatcgatgcgatacgatgccgatacgattatatcctgatcgactgtatgccgagccttggtatgatgacaatcaatgcactggtctcttccgattctgtgctgatacctgtgcaagccgcatatctgccggtgaaaggacttcagcagctgatcaagaccattcttacaggaaagaaaagactgaatcggaaattggcgattgagggcattctcctgatcatggtagatttcagaaccaattacgcaagggatattgcatcgagagtacatacaacctacggaagtcagatcgaggtatttgaaaatgtgatcccgatgtctgtaaaagctgctgagaccagtgcagagggaaaaagtatctacatgcactgtccgaaaggaaaggttgccgaagcatatatgaacttaacacaggaggttttgaagaatgaaaaatagaagtggcgaaaagattaagctggcaagtattgacgaactgctcggagtagtaaatgaagaatctgcaatggagatagagatcagtaagatccatccgtttaagaatcatccgttcaaggtgctggatgatgaaaagatgcaggatctggtagaaagtgtaaagatcaatggagtgctgacaccagtactgcttcgcatggatgaaaatgaagaatatgaaatggtgtccggtcacagaagaatgcatgcagcacagcttgcaggactgacgactattccggctatcgtaagagaattatcagatgatgatgccattgtagctatggtggacgctaacattcagcgagaggaattgttgccgggtgaaaaagcttttgcttacaaaatgaaacaagaggccatgaaacaccaaggttctcggacagacttgactttgggacaaaatgtcccaaagttcaaaagaacaacggaagcaattgcggatgggacaggtgaaagttataaacagattcagcgttacattcgactgacagagttaattccggaacttcttgatctggtagataacaaaaagcttcagttcacggttgctgttaatatctcctatatcgataaggaagtacaggaatggatttacgaatatattagcgacactggatttatcaagccaaaacagattgcaacactcagaaatcaactgaatgatgggccaatcaatcagattcagatgttatcaattttcaataactgtgtgatggcaaagaaagtatcccggtctctcacattctcggaaaagaaactgacaaagtactttccggatgattacacagccaaagatatggaacaggtgattgaatcattattagaaaaatggacgcaggaacagtcttgttaaagatagaaaaagctaagaaaacaaagtcaaagaagtttaaaaagaggacttcttagcagaaaatgaaaggaggaaattatggagaaaaaaatgacatttaattatttttacggtaccgaagctgatctgttcagcttctaccgtataccaaaagcattatttacagacagctattttaaagatttatcgagcgatgctaaaattttatatggactgatgttggatcgaatgtctctttccatcaagaatcagtggtttgatgacaaaaacagagcatatatctacttttccatcgaagatatcatggaattactgaactgtggcagaaataaagccatcaaatccatgagagaactggatgacgaaacagggattggcctgattgagaaacgcagacagggatttggaaaggtgaacgttatctacgtgaaaacctttatgcctgagaaaacagatgagaaaaaatttgaagaggaattaaagaagtttaaaaaacaaacttctgtggaaaatgaggaacctacagaagtttacaattcaaacttcatgaagtcccaaaatcaaacttctagaagtcccgaaaacaaacttcaagaagtttacatttcaaaccctaataatactaatcttagtgatactgaaatgaatgataataaatctaatcctatcatatctgtggatgagaaaagatttgatagcgataatcgctctgaggattatcaggcttatgaaaaccttgtcaaagagaccattgattatgaatcactggaagtaacccatcatgacgatatgcgacaggtagatgaaattgtgaacctgatcgtagaaactgtgatgtgtaaaaatgacaagatattgattgccagcaactggtatccggcatcactggtgaagaaaaaatttctgatgctgacctattcacatatcgagtatgtcttacactgtatgagtggtaacaccacaaaggtgaagaacatcaagaaatatttattagcagccctgtttaatgcaccgtcaacgatgaacgggtattatcaggcagaggtgaaccatgatatgccaggactggtaagataggaggtgcacatgtttattttaaaacttgctgggaagatattattactgccggtatggctgatcctttttgtgatcggcctggcagtgaagatgacagtacagacttatgcagttgtcagaggaatccttggatttatattcactttgttgattatagcgactgcatactgttaccatgactgggtacaggttgcatttctgttttcgctgagtgtaattctgtatctgatcctgtttgcaggagtgttcgtagatactgtactggacatgacaagagaacgtattattgattttattatatcgtgaggaggatatgaaaatgagcgaaaacaatgattatattcagttaccaccactaaaaaaagacacaccatccgatgtggtagcatttatgtgggagtacctgaaagtaccggaggattcaagagaaaaagttaagaatctgcttaaagatgcaaatgaaaatagagtaaaattaagtcatcaggcaccaacactgtatgatgttgtcccaaaagaagaaattgctgaatttgaagagcttatgcgcaaaaccatagctgacattgtatcagaagccagtagcgttgcctgttgggtgtatgtgcagaaatatgtgaagcacaaaaccctaaacgaaatgctgcaagaattgccagacgtaggtcaattcatcctagctatggatacctggtttgaaaaactgatggagaaataatctaggaaaatagtttaaagtttacatgttatgatcatgtatgaagttggaacagaataaaagattgtgctatactattgttcaagaaaaaaactcattgacatatttcaatctatttaggaggataaacgatcatgtgtacagcagcaacttataaaacaaaagatttttactttggacgaaccctcgattatgaattctcttatggtgatcagatagtaattacaccacgtaattatgcgtttaattttcgccatgttggcgatatgaaaaatcattatgcaattattggaatggctcatgttgcagaggattatcctttgtattatgatgctatgaatgaaaaaggagtggcaatggcaggactgaattttgtcggaaatgctgtttatgccgcgattaagccagatgtggaaaatattgcacagtttgaatttattccgtggattttaagtcagtgttcttctttagttgaagttcgcgagcttcttgaacgaattaatattgttaatactcctttcagcgagcaattaccattagcacaattacactggatcatttctgatgagaatgagtcaattacggtagaatctatgtcagatggtttgcatatttatgacaatccagtaggagtgcttacgaataatccgccatttccacagcagatgtttcaactaaataattatatgtatttatctcctaaacagcccagaaatactttctgcgaaaatttggctcttgatgcatatagtagaggtatgggaggattaggtcttccgggagatctctcatcttcctcacgctttgtacgtgtagcttttacaaaggtaaatgcaatttcaggtgaatcagaggaagaaagcgttagccaattcttccacattctcggatctgtggatcagcaacgaggatgttgcgaagtagcggatggaaaatatgaaatcacattgtatacgtcgtgttgtaatgttacaaaaggtatttattattacaatacttatgaaaaccatcagatcagtgcagtagatatgcatgtagaaaatctggatagtgataaaatgatttgttatccagtaattcaaggagaacgaatcaactatcaaaataaataatgttttgaaatcagggatgaagtagaaaggaaagtaccatgacaaaggatgaagtaaaaaaactctggatggacagtccggaatcactacagtttttaaataatgctacaaaattttataatttaatgatgatgtatcgttgtgctattcgggagatacaaactaaacttgaggttttggatgatgaattttcagttgagaacaatcgaaatcctatttcttttataaaaacaaggattaagaagcccaatagtatttacaataaattgcagaaaatgggacatgattttacaacagaaaatatacagacatatttaaatgatgtagcaggcgttcgaatagtttgtgcgtttattgacgatatttatatgatatcagatttgattacccaacaggatgatattaaagttattgaaataaaagattatataaaaaatccaaaaccaaatggttatcgaagctatcatatgattgttgaaataccagtattttttgctaagggtaaaacacctatgcgtgtagaattacagatccgaaccaatggtatggatttctgggcaacattggaacatcaacttcgctataaaaaaggaattgaagaaatgcctggttatgatgagataagtgaagaattacttcattctgcaagagctatcattgaagcggataatgaaatgcagagaataaaagacaaaattggtatgtttcatgaaatttaggcagaaaactgagcaagtaggaaggtggaatatatatgaagcaagatactttagagggcaaagcaaaaacaaaaaatggggtaaaacggctgtgtttttccatagtctgcattcttctggaagtaatttttattattactatcgtaacacgcttgaatgaatatgcagaaattataaatttatttacaaggattttgagtggaatcttggttttgggattgtacgcatcagataagacctcttctatgaaaatgccttgggtcatcttaattctaatcttcccaattatgggtgtaggcctgtatttgttgattggtttgaatggtggcacacataaaatgcgtgaacgatatacagaaattgatagtaaattattaccaatgcttcctgacaatcaggagtgtttgagtagaataaaagaaacgattccgaaagcaggaaatatcgcaagttacatacaaagaaattcgcagtatccaatctatcagaatacagatattgtgtattttgatgaagcagtgacaggattagaggcacagcttaaggatttgaagaaagcacagaaatttatcttcatggaatatcatgcgatagaagacgctgaagcatggcataagattcaagatgttctggaagagcgagtaaaagcaggtgtggaagttagagtattctatgatgatatgggttctataggctttattaatacagattttgtgaaaaaaatggagcgaataggaattcattgccgtgtattcaatccgtttatgccaggtttaaatctgtttttgaacaaccgtgatcatagaaaaataacagttattgatggaaaagtcggatttacaggtggatataatctcgcaaatgaatattttaattacacacacccgtacggacagtggaaagatacaggtattcgtttagaaggagatgctgttcagtcgcttacggtgacatttttggagatgtggaatgcagtaagtgataaggatgctaatgattctgattttagtaaataccttttccattatgattatgcggcacagcaaactgggtttgttcaaccttatgcagacagtcctatggataatgagcaggtaggagaagaagtttatatcagtatgataaataaagctgaaaaatactgttggtttatgactccatatctaatcataacagatgaaatgacacatgcgttatgcctggctgctaagcgaggggtagatgtaagaattatcacaccgggtatccctgataagaagttcatttataatataacgcgttctttttatcatggattagttaaacatggtgttcgtgtttatgagtggactcctggtttctgtcatgcaaaaatgagtgtggcagatgactgtatggcaacctgtggaacaattaatctggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactgggacaattatttatgagattatttgctggattgctataagaatctgatgaaacgacctttcaaaaacagttgattttagaagttaactgtttttgaaaggccgtttttgttatatctaacagtctgttgtacaaagaagattttgcatggatgaaaaaacaaaccttgttgaggttaaattgagttttccattgtattgtattgctaatgaataagaataagaaaaagaacagacaatgctgaatgctctggaaacaagaatatctgagtatagtatgtaagttcgtaacagaatgaaaggagcgattcaaatgagcaatttggaaaattatatgaaacagcaagcaattttttgtgaacaaaatgatagcattagtaagaatctgtattcagagtatggtgtaaaaagaggcttacgagatgaaaaaggccaaggtgtgttgacggggcttacaaatatttctgatataaaagcttttgaatatcgtgatggagtaaagagtccatgtgatggcgagttatcttatcgtggttataatataaaagatttagtaacaggaagtaaaggaaaaaggtttgtctttgaagaaggagcatatcttcttttattcggagaattgccaactgatacacagttaatggaatttcagggaagactatctgattgtatggaactaccgactaactttaccagagatgtcattatgaaagcacctacatcagatattatgggttctatgactcgaagtattcttacattgggctcttacgataaggagaaagaaagtcttgaaattccgaatgtgctaaggcagagtatgcagttgatcgcagcatttcctatgttagcagtatatgcataccatgcttattgtcattatgaaaaaaaagaaagtatgtatattcatagacctgaaaaagatttatctattgctgaaaatttcctgcgcctattaagaccagatacaaaattcacagaactggaagcaagagtactggatatagcattattgttacatatggaacatggtggtggtaacaattctacattcactacacgggtagtaacatcttcaggttcagatacttattctgttatttcagcagcaatgtcatccttaaaaggaaaaaaacatggcggtgcaaatctgatggtaatgaatatgatggatgatattaaaagtcatgtgaaagattatgaagacgaagaggaaattgcatcatatctgagtaagattatgaagaaagaggcgtttgatcagaaaggacttatttatggaatgggacatgctgtatattctatttcagatccgagagaaagggtgttcaaaggctttgtagaacaactcgcaagggataaaggacgtgagaaagatatgaccctttataacaatattgagaagattgcacctaagttgattgcaaagcagcgtcagatattcaaaggagtaagtcctaatatagatttctatagtggttttgtgtatgacatgttgaatattccaagagaattgtacacgccattatttgcgatagcaagaattgctggttggagtgcacatcgcctggaagaattgataactacagataagatcattcgcccggcatataagagtctagtcagcaaaaaagaatatatagaaagagaggaacgataatatgggagcaggaaccagtgcagaggagtttttttaaagagcatcaatgttgaaagtatatttgaatttgttgaaagaacagattatttgttcctttatagtataaaggaatgtgttgaaaaatcagactgtcatgaaggagtatatctttcagaagtggcagaatacatgaaattatcgattccagaaacatctaagatggtaaaaagtcttgaaaataaaggatatattatctggaaattagatgaaaaaaaagaaagaacataccttgttttgacgaacaaggcaattgaattaagtaattgtcagaaagaaaaaatgatagaagcttatgaaaaaatcatatcgaatatacaagaagaggacctggcagttacacgatgtacattgagaaaaatccgacagcttatggaagaaataaaatagtgattaatacaacggagtaagaaaagctccttcatatattagaataaaaatatgactgtttctttaaaaagaagccggtcatatttttttatgaaaaataaattttgttgaggttaaattgagattgactttgtattgtataagtatgaaataaaaaggaatcaggtgatgtacaatgaaaaagcataaaatatgtaaaatccttcttgttatactggcaatttttttatgtgtggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgatcaagaatgcaaaaaaggaaattattctttctacttttgcatttcaatccgatgaaagtggaaaattgattttaggagcactgcatgatgcggcagacagaggtgtacatattcgtctgttagtagatggaatggagagctggattgatatggaaggaaatccgtatttctatggattatcttcccatgagaatgttgaaattaaactgtataataaggccaatccgttgaaaccgtggaaaatgatgggtagaatgcatgataaatatttgattgcagatggaaagagatatattcttgggggaagaaatacatacaattatttcctgggtgattttccgggacataagaactatgacagagacgtgttagtggtttgcgatgaacctgagaaagaaaattcagttaaccagttgtcagagtattttgaaaccatatggaatcaggaagacagtggttattttcataacaataaaaaactggcaaatagaaaatctgtaaagaacgcagttttagagctgcagaacagctatcagaaatattttgaagagaataaggaaagaatctgccagaccaattatacggacgaaacttttgagacagaaaagattacattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaagagattgcagagaacgtttcagatttttctatcatgacaaattcagttgcgaataatgggaatccatttggggctgccgattatgcgaaaaacagaaatagaatcttaagtacaggaattaatatctgggaatatgaaggcggttattcataccacggaaaaagtattctgattgacgatgatctgtctgtaatcggttcttttaatatggacatgagaagtgcatatctggatacggaactgatgcttgtaatacgcagtaaagatattaataaacagttggaagagggcatgatggaatatgaaaaagtgtcccgccagatattagaaggcggaacttataatgatccatatcatgtagagccaatcgaattaacaaagaaacgtcagagaaaaatatttttggtacagcatctgcttggatgggcaaggtatctgttttaataaggaggaaggaaaacgtgtttcaaatattgattgtagaagatgataaagaattaagccagctattccaaaaagtgcttgagaagaatggatatcaagtcaaaagtgcatcggatggagcacaggcattagaagtattggataaggaatatattgatctgatcatttctgatattatgatgccggttatggatggctatgaactggtgtcagaacttcgttcagcaggatatcagataccagtgcttatgatcactgcgaaaggttcctttgatgatatgcgccagggatttctttcgggaagtgacgattatatggtaaaaccggtaaatgtgaatgaaatggttttaagagtcggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagagagcgttttaaagataaccctgattttgaaatcgtaacaatgcgtggaattggatacaaggtggtgaaaaaataatggaacaaaagaaagaaaaaggattgcggatccgatcctgtctgactggtgcaatctggctggcacttgtattttcaacagtcatatctgctttattatttgcttttttgaatcatttttttaatctgccgggcagcatacctgtgcttggctggcttttgattttcaatacattgattgcagggctgatcacttcctttatcaatgcaaagttactggaaccaattaccagacttagtaaagcaatgaaggaagtttctcagggagattttgaacagcatttggaaacgaacagccgtatagcagaagttggagaatcttatcaaagttttaacgttatgacaaaagaacttcgtgcaacagaggtgctgcagatggattttgtatctaatgtttctcatgagtttaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagcccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcagatttgttatagagctgccaaagcagaaagatgagattatatagttttaagataaattagaagatgggaggatttatatgacattttatcaggagttgcagttaaatcaggcaggttctaaaaacctgttgaaaaagagtgaaacactaaaagaaaaattatatcatatatgggtatatctggtgaaggtagctgttacaatggcattttgttttttctttgttagtattttcagcatcctatttggaaatgagaacagcattgtaggtgtagtagtcttattatgtctcatggtgtttagaaatgcggatctggggatccacaccggacaatctatgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacaggaaaaagctatcagatgcgattagtcggaatggctttaggtgcagcacttacctgtttcgtattttatcgaaatcataaaaacagaacttataaaagaaatctgaaagatctaatacaagaatttgatatcacttcttccagaacaaaatggcagatatgtcagattttatgcgtaccgattgtcctttgcattgcagaactttgtaatatgccacgtgcaatgtgggctggtattgcggccatgtccgcgattttgccgtttatggaagatatgcactacagagtccgtaaaaggattgtcggaaatattgcaggtgttatatgttttacagtattatattttctgcttccttcgtcaatctatgcatatataggaattcttggtggaatcggtgtaggattttcagcacaatatggctggcaggcagtatttaacacatttggtgctttagccattgctgcagagacttatggactacaaggagcggttagtcttagagtgattcaaaatgtttttggtgttgtgtttgctttagcattttgtgttatattttattggtttatgtctaaaaaaaaggaaagtgaggtgaccgtacatgcagagtgaagtgaatcaggaagaaaatttgaatagaattattacggttcctaatcttctttctttttttcggctttgtctgattccggtaattatatggagttattgtgtaaagaaaaatcctctgttagctggtgaaatcttattgctgtctggtcttacggatcttgctgatggatatatcgcaagaagattccataggattagtaatttaggaaaaatacttgatccggtggctgataagctgacacaggcagcgacgttaatctgtctgtttactcgttttccgcatgtgcttcttttaatcgtaataatggcaggtaaggagctgtatatggtagtcagtggatgtcttgtgatacgaaagacaggaaaagtacatggtgcagactggcatggaaagatagtaacttttttattatatggaactgcagcggtgcatattatatggttccacattacaccgatggtatcagatctgttgattggtttgtgcgctataatgatggccatatcggtcgctctgtatattatccagaataccaggactcttaagggagagactgtataagcaattttatattgcaatgactagaaaaatatttaggagaagatagatataaacagtaagtcaaacacacaaactatggagtctttagtcggtttaataaaattttagatagaaaataaatcattataaaaaggggctgtcgcattaatgaatgaaccgctccccgtcaagtagacaattgaaaaaatataaatttttcctgccagtagaaatttatctgctggcagtttttatgcagcttgcaagtaaatttcgtgtttttccattggcgttaaaattccgagattcctttgcaagcgtttattgttgtagtaatctatataatcttcgatcattttttcgagagtatctctatcggtgaatcgttttccatagtatcgctctctcttcagaattccccaaaagccttccattggtccattgtcgatacatttagcaactcgcgacatgctttgcgttattccagcatttacaagttttatatgaaatgtcctgttcgtatattggaatcccctgtcactgtgaaacagtggctgcgcaccaggatttctaagtaaagcattatctaccgtatcaaacaccaaagcattgttgttcttatcacgaataacatacgaaacaatccgtctatcatatagatccagtattgcacttagataaactttatgcttttccatcccaacataataatggaattctgtcacatcagtgagccatttttcatttggtgctttggcagtgaactcccgattaagtatgttttcagctatatactgagggtttgcagcctgtcttgtgcatccgttgttagaatacttgatagttgattttatattaagtttacggcaaatgcgtagcacacgtttatcgtttacatcaataccatgatatcgttccagatcatctctgatccttcgatagcctttatccggtgagtctgtatgaatcttttctatctcgtcggcaataaacttattcttttgttcacttttaggaatttctctgtgtagccatttataataagctgctctagaaacattaccaagtttacaaagtgcagcgattggataattatgttctttgtgttcttctttgattgcctgatatatatgttcatgacggaccaggcttaaccccgcctcctctctatttcttcgagtttttttaaaaaagatgcctccatttcagcacgttctttctctgcttttaaaattttaacttcagcacgcagcttttctaattcactcatctcatcgggacattttcgtttgccacggttatctcttaaagcttccactccaccagcttcatatttgactatataattgcgagcctgttgataggatacctgatattgttctgctgtttgggcataattacgatcatgtgcgatacaatactgtactatttcaacccgttcttcaaaagtggtttttcttcctttggtcatgataatgcttcctcctgttccagaagattttaattcttcatgaccattatacttctttatccaagattgtaacttaccttttgaacggattccatattttttgcagatatcatcttgagaaccatagcctgctaaataatctaagactgcttgctgtttcaattctttggaatattttttatttcctttcaatgtaaatgcatttgctcccatagattcatagtttcgaatccattgttggacagatgcgagacttacatcaaacatatgggcaattcgttgttggctttcttttccatccagatatagatttacagcatatatcttattctcaacagatacttttcttttagacataaaatatgctccctcctaagtgacaagtttttattatttcacttgtctacctagaagggagcatatcacttaatgcgacagccccatttttatttttgttaggctttaagcctgttcagcacagtggagtttctcagaagagaaacggaactttgatgaacaaataaaccaccggctaggccggtgagtcagcattgcttaagcttacagtaaaaaacctccagtgatataattatgttggttcgccaaccacataaaatcaaaggaggttatccaaatggatataaacagtttagcacatacgaaatggaattgtaagtatcatattgtttttgcaccaaaatatagaagaaaagtagcgtatgggaagatgaaacaggatattgcgaatattttaagtatgctatgcaaaagaaaaagtgtagaaatagtagaggcagagatatgcccagaccatgtgcatatgcttgtaaagataccaccaagtttaagtgtttcaagttttgtagggtatttgaaaggaaaaagtacacttatgatcttcgaacgccatgcaaatttaaaatacaaatatggaaatcgccatttctggtgcagaggatattacgtagatactgtagggaaaaatgcaaagaagatacaagaatatattcaaaatcagttacaaaatgatttagagtatgatcagatgacattaaaagagtatattgccccgtttacgggtgagccagtaaagcaaaataaataaaataagccccgtagggcttaataagtaaatgacggtacagttagcgaaccaaattcgatgggtctttagacttagcgtcggtaataagcccttatagggctagtacaaaccaccggctaagccggtggttttgattgaaaataagcctaaaaatagctgtgcccacgtcatgcccacggaaattttctcgcgtgggcatgacttttataaaaatgacgataaattggattattcagacggtgatatttgatgcatatatgactgtatataaatgtcaacattaaaatgtacatttttgatcatttaagaatgtacatttttgctattcttcctcttgatcggtatatttttttaagcgataagattttcctgtgatatttaccacatgtgcatgatgtaacactcggtcaagaatcgcatttgcgatcactggatcaaaaaatacatcatcccatgaattaaagttgatatttgtggtaatgatcgtacttcttttttcatatcgcttgtcaatcagttggaaaaacagctttgcatcatcttttttaatcggaagataaccaagctcatcaatgatcagcagcttatatttgaaaaagtgttttaatcttgcttctagacgattctccagttttgctttttttagctgcatgatcagatcatggcatttgataaaatatgtactgtaacgtttttttgctgcagttactccaatcgcagtggcaagatgtgtcttacctactccgctcggacctaaaaacacgatgttttcagcattttccagaaatcttaaagttgcaaaatccttgatctcttccggattgacggatggctgaaattcaaaatcaaagtcactgattcctttttgatgagggaaagctccgacttttaccatggaacggatcatgtttgcttctttaaaatcaatctcataattcgttagtttacagagtccttccgtaaatgataatggtgacgaagtgatcagatcaatcacttcatcaagatgaagatccatctgattcaatttcagatactcaaggtttttctttaattgtacatatgtgctattcatttttaaacattgctcctatctgtgtcaggttttcttttgcgatcttttcaatatccattgtctgctctttgaatgtctgtttactgatagcaacataatgatcgtgtgtataattaagtttttttgcactgatcggatgtatcacgatcagttctgtgttataatacacatacagataattatcatatacctgtaataccagacgttttccaagatattttggtggtacggaatattgattggaacgataagtgatcatacaggatgaattcacttttacagttgtatgggtcatctgataaggctttcttatcacattgcgtggaagtggtgataagtgagccttttctttttgaagatacatcacagggatccttccggttcctgggtgcaccgcatgattgatccgttcattcagtttatggacaagttgattgagctcatgataatcgagaagtccgttataagcatagatttcatcgagcagtttcatcggagcttctacttttgcttttgtctgaggccgtgcagcaatacagggtcgtaccttaaatccataatctgaagcaaactgggcaaagcgtggattcacttttcctttactgtaagcagtccgtggctgatccatgaccgtcttcatgttatctgtcagaagttcttcaggaactccaccgaatgtttcaaaggcatcatcgataaaggaacataagatatcctgtgttttcgataatgataatctgtaaacacgaaaccgagatgatgacagcagcaatacaaagatgttgatatcgatccattcaccggattttaacagaaactttatggattctttccagtccagctgtgcctgtttcccaagaggagtttcaaaacgcagatgagatttctttttgatatgtcgtttctgccttcgttcaaaataagactggaattccgaatgctggctgatgtatctgcggaaacttgactgggcacaggaaagcccatgattatcttttaagaattgccataaaacacgtttataatagaaaatctgctggttttcatcggaaagaagatctttgatgatatcataataatcatcaatgcaagatgaacgcctgcgggctgttggtttttcatatccttttagatatttatcaaccgtccgtcgatcttttcccagctctctggcaatctgacttttattaattttcaatgtactgtcctccaaaaaaggggttagttttaccagatcccttaaagaattgatctgaatgtcactagtaatctttggtgtatatatcataataaattcctccgtagagaatttattataatgtgattttgtacatttttaaatgatcatttctgtacattcttatattagcatttataactgtatagtgtttgctcgaaaagtatatataatgaatgcgtgtatttaacttgcatatttagcaaataagtttcataatagaatgtgtcgaacaaaatcaacttgaaaaattaggggtttctgtcgacccctgatagtgcaaaaaatataggggatcgacagaaggcggaaacgcctaaaataggaggtgttgcagaaatatatgattagggacaagaaagaaatgttgaattttgaagaggtcgacaaaatagagacgttttttggcttaaataaggggatgattttgggacgggaattaatagaatcataatggaatttaaataagaaaccaaagaaacaggaagaagaacaagaagaacgaattaatagaatcataatggaatttaaatcccttcttggttttgtagcctaagcgattcaaatggaattaatagaatcataatggaatttaaatcagttaagtttattagatttagttcttgaaagcttggaattaatagaatcattataatggaacttaaagatggatttcaatgtaacaggttggaaatcttaaggcacttgggaccaaatgagtcaactggaaccttaagaatatagattagaaggaaaaatctgataattaaaataagcgtttaatccagaaatgagatgtaaagaaaagaataaagagctggttttaattgtaaaatttatggggaactaacatcagcttattgacataaatttaaaaataagtataataatagttgagtagttgttcaattattattatttggaggtgaatatatgccaaaaacgtcttatatttgtaattgcaatgtaattcatgaggatattgtgaatgatgtgaaatccaagatgcagccaaaagatgattatatccagttggcttctttgtttaagctatttggagatggaactagagtacaaatcttacacgctctagaacagagtgagatgtgtgtatgtgatcttgcagtgctacttggggtaacaaaatctgcaatttcgcatcagttaaaggcattacgccttgcgaatctggtaaaattccgtaaagaagcacagatagtttactactcgctggcagatgatcatgtgaaagagattattgacaagggatttgagcatctttggcagaaataatattttttaacattatagttgagtaattgaacaattaaacaaattataagtttggagaattgagaaaatcggaattttggaggttattatggcttttgattttaaaaaagagtataaagaattctatatgccgaagaacaaaccagagattgtaaatgtacctaaggcaaattatattgcagttagaggaaaaggcaatccaaatgaagaaggcggagcatatcaacaagcaatcagtgttctatatgctgttgcatacacattaaaaatgagttacaagactgattataaaattgaaggattttttgaatatgttgttccgccattggaaggtttttggtggcaggatgatgtcgagagtgtagattatacaaataagtctgctttcagctggatttctgttatccgtttgcctgatttcatttctaaagctgattttgactgggcggtagaaacagcaacgaaaaagaagaaacttgattgttcgtcagcagagtatcttacaattgatgagggattatgcgttcaaattatgcatataggttcttttgataatgagccagcaactgttgcgcttatggatacttatttagaacaaaatggatatgttaatgatattaacaaagataggttgcaccacgagatttatatgtctgatgcaagaaaggttgccccagaaaaatggaaaactgtaattagacatccaattaagaaagcgtaaaattcccgtttattgggaagtcgcagagaacgaaaaatcgggatttaatttatacatttggaggtggtaaacaatgagaaaatgtgtaaaatgcggaaaagttatggtatcagatttaaggcttaaagtaaatggtggtggctatgggattgttgttcgtgtagatgaaaagcaaaaggcaacaattatagatgatgtaaaagttgcagtctgcccagagtgcggttatacagaaatgtacttaaaagattaggcgataacttccagtttgtatatatcttttaaaaggtatatgattaagaaaaacggcaggaggtatctgaatgaaatcacataaatattggtctatcggtgcactgattacaatgcttggaactttttatacaggttataagggatcaaaagaaggccataagtactttgcagcaagttctttgctttgcatgattatggctatttatacaggacacaagatgatttctggtaaaagtaggaagaaaaaagaagtttcagtagagagtgttgaagattaaaaaacaaaatattttaataaataacgccggtgcgggatttttgatatccagtactggcgttatttattctacaggggcttgggggtgtagccaccaaatatattattaattttcttcttcggtaagtttgttaaggatccactccctattgataacaatatcctcatcatcgcggagatctttgaaatcagtgcagtgtgaagaagcaaattcatacatattgtcaatgtcaactgagtaatttgtatttctgcttttaatgtgctttacgattgccattcataccacctgccagttttagtacctcttttctcagtaggaataagtccgtgatgcactgatggatttcattttctatagcacgtgactgattgccaccactgttaaaatgcttggcgatctgattgagattcgatccgatccgatctttccatattcactgaccagttttctgaggtcgttcatgtctgcaacaacttcaatctggtgattgatttgctttgaatgtttaaagatcacgtggaagtacctggacttgataaagaaaaatccaaacttgatgatttaatcaaccagatgagatattttaaagattttatcaaaaaactcaatcacatggatgtgatatccaatcaatctcagcatcagattaagaatggtgaaatgctccttgcaaacaaaatatatctgataaatcagatgtattaatgtcccaaggacgctttttgtatgttataataaatacaatcactaagtatcggataaataaagataaaatgaaggaatagaaagtcatgaagatagcgaaaaaagtattaaagacaataggagttttattaggctttattgtggtcattgtgctaggatatatcatttatctctatgcaagttaccatagaattgaagataataaatccctttccgtagaatctcacacagaaacaaaacaaacactaacaacaggaaaacaatattcagcaattacatacaatattggattcggagcctatacgccagatttcagcttttttatggatggaggaaaatcatcttgggcaaagagcaagaaaagtgttcttaaaacagttaaaaatgcaggaaatctaacaaaatcgtatgatccggattttgccttaatagaggaaatagatcttaattccaccagaagttatcatgtaaatgaatattccatactaaagaaatgcttgaagaattacgatacagtatttgcacaaaattatgattctgcttttctattctatccattcacacagccacatggaagtagcaaagcaggattagctttattttccagatatccgatcaaagattcactaagaagaagtcttccgatttcaacatcatacaataaattttttgatttagatcgttgctacagtatttcaagaattccagtggataatgggaaatacctcgtgatctttcagcttcatatgtcagcctacggaaacagtgataagatcagaaaaggacagatccgtatgctttcagcggatatgaaaaaagaatacgaagcaggaaattatgtattatgtggcggggattttaaccatgacctcaaggctgcagaagatgacgattctaccgatagagaatcctgggcatatccatttccaagaaagatgcttccagaacatttttctttctgtatggatcaactgccaaagaaagaaaatctgtggaatagttcacgaaatgcagatatgaaatacataccaggaaagacttacactgttacattggatggatttattatctcagataatgtaaaatgtgatatgtataagaatattaatacgggatattcatattcagatcatgacccggtatatgtgaagtttgaattgaataaggagagtgtgttgaacaaatttaaattgaaaaattagagatttctgtcgacttgtgatagtacaaaaaatataggggatcgccagaaggtggaaatgtctaaaataggaggcgttgtggaaatatatgattaaggacaagaaaaatatgaagaaacgatggaaaagaatcatatccaatatgattgcaatagcactagtgatcatatcaagtattccaacaatttcaattccagtaaaagcggaagcatctgttgatggaaaattgatcacagtaggtgggaaaacggtaacaaaaaatatgaaaattgatgatgttaagaaaatgtttggtgaaccaaaattaacgacaccatcatattgggatggatatgcttatacattttacggaaaagattatagtgattatttatatttagaaactgattctgatgggaagattgtatgttatggaagcgtaagtcctgggttcgaaacgaataaatacagttatggagagaaagttaatccttatgctcgggcaggttgtgaggcgaaagacgatgatggcaagttatatgctgtgatatattacacaaaatttcatttggatgcatataagagatttacagaaaatttaacagaaaataatagaaatctttgcaaacatgcagtggaaatgtggaatgctatttcttatttatatggatataaaactgcaacatattttgatgaaaaattgtttaatataggtgcacagctggcagataatcatagcgatctatatgattattgtaagagcacaaatcaaagttcttgttatcagttaatgactggaagaaaagccacatttctggaatatttttaccctaatccattggaatttgcggaaaatgctagaaattacgagtgcccaaaaggaaatgcaataggctttatgtattatccaacaggagaagaaaatgatgattattggattatggaggggtttgtaaataaagaattattggcagattggaagtctgttgcatatacagaaagagaaaaagagttattggaaaattccagaaaatattatacaaactcagtaaacacagttaattctatgaaatcatattatgagattaaaccttcttacgattcaattaagaatatagaaggtggaaagttaagtaaagaagttgcaaaaggagcagttgattatttaaatgcaattcgtgtgggagctggactaaatccattggaatattcagaacaattgtctatggatgcacagtgcaaatctacgtacacggtatatttggcaaaaaataatataaaaaattcatcacctcataatccaccaaaggtagagggattaagcgatgaatattattcaaaatgtcaaagtggcaatggagaaaatttatactcatgtggaataataagtacgagtatcatagacagtattagtagtgcattagatgatagtcaagggacaggacaatattataatagaggccatagatataatctgttaaatcctgaatggaaatatattggagtaggaaatacgttgcaacaagcatgtcataaattgtcaggaacgcagagctctaatgtagatgttgttgcatggccaccaaaaggaattactatttcagaaagtggattttcgccatcaggaatgtggacatgtcagttttataataagttaaaaccgacagctgatactacaataacgattgaatgtctcaatagcaataagaaatggaagattgatccgaataatcttttagaaaatcaagcttataattatgaaagaagtggggatcttatttcctatagcgatgattctattgtttttaaaataggaggagtttatcaaataacatatgatcatcttacagatgcaaatgggaatgaaacaagttattcttatagaacagtgtatgaaaaagcttatattggatcagaagaggagaaagtaccacaatctataaaattagataaaacatcagaaaaagttttgcttggtacaacgagtaagttgattgccaaagtaagcccggataatataaagaataaaagaatttattttgcaagtaataacaaagaagtggctactgtaaatgaatgtggtgagattacagcccattcgttaggaacagctgatataacagttacaagtgaaaatggaaatataacagctacatgcaaaataatagtagtaaaaactttagatcagacagatgatcagccagaaaaggaaccagaaaaggaaccagaaaaggaaccaacaaaggaactagaaaaggaatcaactggagcaataacaaatggaaatgttaataatagtaataacaagtctgatttatcacaaggacataaaacaaataacaacaaaaaagaaaatataaccattagtaaagcaaaaattaaaagtgcgaaaaagaaaaaatcctcaaagtccttaacaataatattatcaaaagcagtacctaaggtaactggttatcaaataaaaatatattcatccaaaaagaaagctaagaagaataagggtgctatttggacaaaggttgtacagacagattccaagaaaatagttattaaaaataaaaaattaaaaaacaaaaaaacactttatattcggatacgtgcttataagagaatcaatagaaagaataaatatagtacgtggtcagagattaagaaagtaattgttaattagtaatgatttcagtgaatcattacgagtgttgcttctttcaagctaaaataaagacagaaaataataactcatgcgatggaatatttaatgtacacggacattccggtaattaagattgcgatgaataatggatttgcttcagttgcagcatttaataaagtatttaaagaaacatatcaagaaacaccatctgcatatcgaaagaaaaagaaagaaacagtagacaatcaggaaagtatgttggagaattatatattgcaataaggatgaaaatgataaaatccctcatgtatgatattaataagaagtttcatatatcatacatgggggatttttaatgtgtattgcttttaagatatttctatgctttaaaatttagaaacaatttttgatgatatcttcgtcaagaccatttttacaagtgatatttcctatcacaaaatataagattccaccagcaagaagtccccatacaacagcattgattccagcaatctgcacgttataataacaaaatacataagtgatcgcagcaccgagagaactaaagactgctgcttgttttgttcctttcttccagaacaatcctccgaccaaaggccagaaaaaactgcattccagaccacctaaggcaaatagattcaagaagaaaatgatatcaggtggattgatcgtaagtaagataacgatcacaccaaatgcgaacgtaacgagcgtgctcattttcccaacatttttgttataagactgaattttcacaggatcatctttgacaacatagttacgccatagatctttcacgatcgctgcagaagcaaggatcaaaagagaatcagcggtagacataacagcagccataggagcagctaggaaagttcctgcaagtccgactggcatgatcttctgaacgatgtatgggataaagtaatcagacgtcggaaggttcttagtatctaccagtgcaccggcccatgtaccagccatatgcataccaacgatgataaaactgcaggtaacagcaccgatccacatcgcagaatgaagactctttgtatttttaaatcccatagaacgaacggctgtctgaggaagtccaagtgtaccaaatcctacaagaatccagaaactaagtagcgtaccgggactgtactttgaaaatagatcatcatatactccaggcagattctgtgccagtccggcatcaataccagcaagtccgccgccagcttttaatacaaagaataaaagtaaaaatgtaccgacacacatgataattccctgaatcgtatctgtgatcgcaacagcgctgaaaccaccaaaagatgtataaatgataacaactgctccaaaaatcaataaagaaacaacatgatcaagtccagtgatagaagagatcaaagttgctccgccagtaaattgtccgatcatctgtgccatgaagaaggcaaccataagtaagctggttacaataactaaaacatcacttttataacgagcctttaaataacctacaacagtaacggcaccagttcttctggaaactaaagcaagtttgttaccaaggacacctagtaccagaaatgtgatcggaacttgaactgtagcgatccatgcctgtgcatatccataagtaagaccagcagctcctggaccagaaataaaggaacttacagaagtataagttgccatggttgtcattgccagaagaagtccgttcatatttcttccaccgatgaagaattttttctcggaggatgtatgctgttttttattctgacggttactgaaaatgataccgatcgcagcatttaaggcgaggtaaacaataaaaattgcaagaatgattttctgatttgctgacatttattcttctccctcctcttcatcgtcatattcaaaattaataaatacatgttttaataggtaccagacaccaatcaaagaaagtatgatcgttccgaatgttgatatactaaaccatgcgggcatacctagaaaataaagaccagtaccatttaacaaaaacgcactggcaatatgccaagcacagcagatcaatacaacaatcaatgttccacggatctcacgcatacactgttcatgtttctcctgtcttgttaattttttcatattatatgatctcctttaataaaaggtcagattcgcaaaggatatctgccaaaagtattatcttacaaatatggaagaaaatcaattattcttaacattttaaagagataagatcaaaaagaatgttataaaatagtttgaataacatattcatctttggtataataaatcatatcagtatgcagaaatacaggaggcttttactatggagaataaaagtagttaccagataaacgagcagggagtgctcggggaagtgaaaattgcagatgatgtgattgcagtgatcgcaggaatcgcagcaactgaagtgacaggagttgccagaatgtgtgggaatatcacgaatgaactggtaagtaaacttggagtgaataatctgtccaagggagtcaaagttgtcgtagagaatcatcatgtaagagtcaatcttgcattagaacttgactatggagttagtattccagagatttctaagaaagttcaagatcgtgtgaaaacagcaatcgagaacatgacaggattaaaggtcagagaagttaacgtccgtgtcacaggtgttgcagcagaagaagagtaagaaagaatataaagcaaagtcagacgggactgatcacagttccgtctttgtatcgcagaaaggaaccataatgaaaagaagtgaggtaagagaacatattttcagaattttattttgtgtagaattttgtgagaaagaagaatttgaagatcaggttgaattatattttcatgggcatgaaaatatcaatgagaagacacagaaagaaattacagagaaaacagagaatctgatcgaacatttagatgaaatcgatgaacagatttctgcacatacgaatgcatggaatttagagagacttggaaaagctgaattatctattttaagacttgcaacctatgaaatcttattagatgaacaggtgccaagaaaagtagcgattaatgaggcagtagaacttgcaaagaaatactgcaatgaaaaggcagcaccatttatcaatggtgtcttaagtaagattggacaggatatggatgaagagtaaagttttttctgtaacacagattaatacttatatcaaacgaatgtttcaaagtgattatgccttaaggaggatttcaatcaagggacaggtgtcaaactgtaagtatcattcttctgggcatatttatttttcattgaaagatgaagaaagccagatttcttgtgtgatgtttgcgagtgcaagatataatggattgcagtttgaattagaagatggacaggaagtcattgtggatggaaatgtcagtgtctatgagcgtggcggaagttatcagctatatgcacaggagattcgtttaaatggaatcggagaattatatgttgcatatgagatgttaaaacagaagctttatgaagaaggattgtttgaccacgagatcaagaagccgattccaaagaatccaaagaagatcggtgtggtaacggcaagaacaggagcagcaattcatgatatcattagtacagcaaagcgcaggaatccgtatgtacagttagtattatatcctgctaaagtacagggagaaggtgcatctgatacgatcgtttctggaattcgcactctggaccagtatggagttgataccattatcatcggaagaggtggtggctcgatcgaggacttgtgggcatttaatgaagagaatgtcgcaagagcgatctacgaagcaaagacaccgatcatttctggaacagggcatgaggtggatactaccattgcggattatgcggcagatcttcgcgcggcaacaccgacagcagcctgtgaacttgcagttccagatatcacagaagtgatggaaggaatcgcaaacagagaatatacaatggctgcgttgttaaaacagatcatccggcgttatcagatgaaattgcagaagtatcagatcaccattgcaaattacgatccacgatttcaacttcaagaacagaagatgcgtttgtcagaattagaagaacagattcagcaagtgatgaagaataagatgacagggtataagcacaaactggaattgtacgcaaaagaacttcatgggttatcaccaacagcgaaattgatcaatggatttggatatttagaagatcagaatggtgagccagttacaagcgttcacaaagtgaaagagggagatcagatttccttaacgatttcagatggaacgatccttgcaatggcaaaacagatcagaacaatggatgaaaaaggaaagtaagaaagaggaagtttattatggcaaagaagaaatttgatattgatcagggttttcatcagttagatgaaattcttacaaagctttccagtgaagaaatcaaacttccagaggctgtcaaactatatactgaaggagtaaatcttgtgaaacagtgtaaggattctctggataaagtagaaaaagaattgatcgtattagaagagaatggggaagaacatgaactttaaggatgagatgaaacaaaaggttgcacagatcgaaattattttagatgaatatctgccagcacaggaagggttacaaaaaacagttttaactgcaatgaacacaaccgttaaggcgggaggaaagcgtcttcgtccaatgctgatcaacgagacatatcagatgtttggcggaaaggaagatatcgtaaagccatttatggcagcgattgaaatgatccatacgtattctctgattcatgatgatcttccagcacttgacaatgatgattacagaagaggtcagaaaacatgtcatatcgtttatggagaagatatggcgatccttgcaggagatgcacttcttaattatgcgtatgaagttgcaacgaaagcatttgatcttgcggagaaagaccagatcatgaatgtagttgaagcaattaagattctcgccagcaaacctggaatctatggaatgatcggcgggcaggttgcagatgttgaactggaaggtacaccgcttagtatggagcagattttatttattcataagaataagacgtctgcattgatcgaagcatgtatgatgatcggagcagttcttgcaggagcatccaaagaagatgttctgaagatggaagaatgtggagaatatatcggacttgcgtttcagattcaagacgatattctggatcttacaggagatgaagaagagatcgggaaaccggttggaagtgatgaaaagaatcacaaaacaacttatgtgacattaaaaggattagaacgttcacaaagagatgtagaagatatttcaaagaaagcaattgatattttagaaaaatatgataagggagattgttatcttacaaatcttacaagatttttgatccatcgaacacactaaggcagagaggaagagggagcattatgctagagtatattaatgatccgaatgatattaaacagattcagccagaggactataaacttctggcgaaagatatacgtcgttttctattaagaaatgtcagtcgcacaggggggcatctggcatcgaatcttggaattgtagaactaacgatggcgctgcatcttgttttggattttccaaaagaccagctgatctttgatgtaggacatcagtcttatgtgcacaagatcttaacaggaagaaagaatggatttgagaatctgaggcaatttcatgggatgagtggattcccgaagagaaaagaaagcgattgtgatgcgtttcacagtggacacagctccatgtcgttatcagcagcgcttgggatggttacagcaagagatatcaatcatacggatgagacgattgttgcggtaatcggagatggtgcgttgtctggcggaatggcatatgaagcattaaataatatggcaagactacgcaaggagaagaagaatctgatcattatcctgaacgataacaagatgtctattgcggagaatgtcggtggaatgtctgcgtatttgaataaagtacgaacaagaaaagaatatgtggaatttaaaggaaatgtggaacaatccttattaagaattccgggaatcgggaagaaattaacaacaattcttaagaaatcaaaagattcgatcaaacaattatttgttccgggaatgtattttgaagatatgggaatcacgtatattggacctattgacgggcataatgttcccttgatggtagacacgttaaatagagcgaaacaattagatgagccgatcattattcacgtggtaacgaagaaaggaaaaggatatcgtcctgcggagcagaatccagccaaatttcacggaatcagtccattttccttaaagacaggggaagttttaaagaaatcggacaatccatcgaacacagcggtattttcagatacactgatcaaagaggcgaagaaagataagaagattgttgcggtaactgccgcaatgccggatggaacaggtcttggaaagtttaaaaatcattttccagatcgtttctttgatgtagggattgccgaacaacatgcagttacattttgtgccggaatggcatcaagaggtctaaagccggtatttgcagtgtattcaacatttctacaaagaggttttgatcaaatcttacatgatgtggcaatcgggaattatccagttatatttggattggaccgctcaggacttgttggagcggatggagaaactcatcaaggtatttttgatattccgtatttatctatcattccaaatgtgacggtgatggctccgatcaatggaagggaattatctgagatgctaaaacatacgctccatcatgcaaaaggaccaaccgcgatcaaatattccagaggagaagcaagctctttgtatgaagatcaatttgaagagttacactatggaaaaggccagatacttaaagaaggaaaggaagctgtgatcattgcagttggaaatatctttgaagaggcagataaggcggaaaagatccttaaagaagaaggatatgagattggtttagttaatccaagatatatcaaaccatttgatcaggagttgatcatgaaactgtcacagacctatgataagatcatgatcgcagaagaaggcgtattaaacggtggatttggaatgatggtgaatgaatttctgagtgagcatgattacaaaggtgaagtcagatgccttggaatagatgaccagtttgtggaacatggttctgtaagtgagttaagaagaatgttgaagattgatggagaaagtattgcagactccatcagacaatggatgaaggaatagaaaaatgaagaaagaacgtttagatgtactgcttgtcaagaaagggcttgcgtcttccagagaaaaagcaaaagcgatcattatgtcaggaatcgtttttgtagatggacagagagaggataaagcaggatcaacttttgatgaaaagcaggagatcattgtaaagggaaaaactttaaaatatgtcagtcgaggtggattaaagcttgagaaggctatgaagaactttgatattgtattaaaagacaaagtctgcatggatgttggagcatctacaggtggatttacagactgtatgttgcaaaatggtgcagtgaaagtatattcagttgatgtcgggcatggacagttggactggaaactaagaaacgatgagagagttgtttgtatggaacgtacgaatatgcgttatatgacggaagacgatatcgatgaaaaggcgtcgtttgtatctattgatgtttcttttatttcactgaccaagattcttccagcggtatatcgaattttgaatacgggaggagaagttgttgcactgatcaaaccgcagtttgaagcaggaagagaaaaagttggaaagaaaggtgttgtacgagatccaaaagttcatgaagaagtcattgagaagatctgtgatttcgcatctacgaacgggtttgaattattacaccttgattattctccaatcaaaggtccagagggaaatatcgagtatttattacatatgagaaaaacagagacaatggagaatggacatacaatgacagatcagatcaaggaagtggtggatgcatcacatgcggatctggcaaagaataaggaataacatgaagaattttttgattttaacgaacgagaaaaaagatccaggactgcgtatttccaaaaagatccaggattatattgaaaaacaaggtggaatcagccagagaatgtgtgattttacaagacatgttcaaaaagatatgaactgcatcacaaaagacacagagtgtgtgatcgttttaggtggagatgggacgatgcttcatgcggcaagattgatcgtagatcatgatattccgatggttggagtaaatctcggtaccttaggattcttaacagagattgagttatctaaactttatgacggattggacggattgttaaatgatactttccagattgaggagagaatgatgttagatgggcgcgtgatccatgcggatcatgagacagatcatcttccagcactcaatgacgtcgtgatcgcaagaagtggtttttcaagaatcatctcgtttcgtattatggtcaatggcaaattgttagatgtatatgaagcagatgggattattgtttcgacgccgacaggatctacaggatataatttatcagcaggtgggccggtagtgaatccaaaagcaaatgttattttgatcactccaatctgtccacattcgctgcagtcaaacagtcttgttctttctccagaagatgagattgatatttatattgagaacgtgagagaatctcagttagaggaagcctacgttacctttgacggtcaggttgcgagaaaacttcagccaggagatgttcttcaggtgcgtaaatcaaagaagatcgcaaggatcattaaagtgaaaggagacagcttttacagaatccttcgaatcaaagttggaggtcagaatgaagaaaaataggcaggaagcgatcattgaattgattcagcaatatccaattgagacacaggaagagttgctgtcaagattaaatcagattggctttaagacaacgcaggcaacgatttcaagagatatcagagaactggcattgatcaagaaaccggatgcagatgggaagcagatttattgtctgatcgatcaggaagatgagacttcaagaaagtatcagaggatattagcagaagcgatcatttccatggaactagcagagaatatgctggttgtaaaaaccgtatcgggaatggcaatggcgtctgctgctgcacttgattctttaaacatcattggaatggttggtacgatcgcgggagatgatacgattatgtgtgttatgaaagataagaatattggaagaactgcaattgctgagatcgatcatatgatcaaaaaattaaaagaataaatatacagagaggaaatctatgcttcagaatttacatgtaaagaatcttgcgttgatcgatgaagtagaaattacatttgatgaacatttgaatatactgactggagaaaccggtgcaggaaaatctgtcttgataggttctatagaaagtgcacttgggaaaaaaatatcaaaagatatgatccgaccgggagcaaaagaagcagtcattgaactgcttttttggattgaagatcaaaagctgatcaaagaaatcgaagctctggatctggaagtagaagacggtcagatcttcatcaaacgtgtgatcaacgagaagagaagtattaataagattaatgatagtacggtgacactcaatacgttaagagaagtttccagacgtttatttgatctgcatggtcagcaagaatatcaagtactgttaaaagagaaaaatcatttaagtatgatggatcattttttacctgaaaacgcaagatattccttagaacagtgcaaaaatcttgcaggagaatatcacgagatttcaacaaagataaaagaaatatcaatagatgaccagcaaagattaagagagatggacttcttaaaacatgagatttcagagattgagaatgccaatcttgtcaaaggagaagatgaggaattagaaacggtatatcaaaagatcgtccatagccgagatatcattatttcttgtcaggcagcacgtatgctgacgggatatgaggaagaaacatcgattggcaatcagttaagtgaaagcataagaagaatgcaggagatcagtcatttagatcctcagatctcagaattttatgaacaactgttgtcagtggaagatctgttaaatggttttcatcaagaattgacgacatatatggagaatatggaatttgatgagcagacgtatcaggaagtggaagaacgtctgaatgttattaattctttaaaagacaaatatggtccatcgattgaagatgttacagcatatggacaaaaggcagaaaaacgatataatatgttgtgtgatgcagaacatgagattgaaatattaaagaatgaacaggaacgcatcagggaacgatatcttaaggaagcaaagaatctgtcagaacaaagatgtaagatagcaaagacacttggaagcaatatcacaaaagcattagaagatctgaactttttagatgtcagatttgaaatcgaagttacgaaaaaagaccagatttcagcagatggaatggatcagatccgttttatgatatcgaccaatccaggtcttccaatgcgtccggtacaagaagtagcatctggtggtgaattatcaagaatcatgcttgcactcaaatcagtagcagcacaggcagatggagtagatacgttgatctttgacgaaattgatactgggatcagtggggaaactgccaatcgtgtagctaaaaagatggcagtgatctcaaaggatcatcaggtgatcgcgatcacacatcttccacagatcgcagcgatggcagatagtcattactttattagaaaacaaaccgatcagaagaatacgcagacaatgatccgaaaattaaatgaatcagaatcgttaaaagagatttcaagaatgatcagcggggatcaatggagtgaaacgtctatggaacatgcaaaagaaatgaaatctttggcagatgaaacaaaattatactgagtatgtaagcggtaatcttcatataataaaaaggatatatcaatgacgatatgtccttttttaggaggaaaaatatgaaaaaatacacttaccgcaaatttttaattctactttttatgatcaatttaatcgcaataactgcagtttatataaaatactgcaatgcaagacttccagatacgattcatatcaacaagagcgaaacagtctctctttgttatgatgtaccagtcagtgcaacgatcgatcatcaaacgatacgattaaatcagcccattgtattcaaacaatgtcacatgggtcagtatgaaatgaaaaccaatttatttggcgcgattccattaaagaagattaaagtgaaggtcgtagatgaccaaaagatcacgccaagcggtgaagtgatcggtgtctatgtagaaacagatggattgtttgtgcttgatacggatcagtttaccggagaaaacagcatggaatatgcaccgagtaaaaataaattatatcgtggagattatattaaaaagattgatggaaaagatattgtatcaaaaaaacaattcatcgaaaaaatcaatcaaggtcaaggagaatctgtgatattaacagtccaaagaaaggcaaagatgatgcagatcaagatcaagccagaacgttcaaagacggatcacatgtataaaattggaacatggatcagggataacacgcagggaatcggtacgatgacctatgtaaaaggtacgttatttggagggttgggacacggtatttatgatatggatacaggcacacttttaaagatcaaaggtggtcttttgctggatccacagatttattccattaaaaaaggaaaatcaggaacgccgggagagattgttggaagtattgaatacaaggaagagaatattttaggttccatcaaaaaaaatacggaaaaaggaatttatggaaccataccaaagaaacaacaaaaagcatacaagataggatatcgtcaagatatcaaaccaggaaaagcttatattctctccaatgtaagcggtactatgaaacaatatgagatccagatcaataagatcgtgccatccgacaaggatgtgttaaaaagtatggagattgaagtgacagacaaagaattattaaaacttaccaacgggatcatacagggaatgagtggcagtccaatcttgcagaatgggaaacttattggtgctgttacacatgtttttgtaaatgacccgatgaaagggtatgctattcttatggaaacaatgctctatgagatggaaaattagagcaaagggaaatggaagctgtttttaaaatataagtttgctacaatagaaaaaagggagggtgagagacatgaaaattttgcatcttggagatctgcatctcggaaagagagtgaacgagatatccatgattgaagatcagaaatttatattggatcagatcgttacattagtaaaagaagaaaagatagatgttattttattatgtggggatatctatgataaggcaataccgacgatcgaggcgattcatctgctggatgaatttttagaagaactgagtgatcttaaagtaaaagtattgatgatcagtggaaatcatgattcttcggaaagattgtcatttggaagaaacttatttaaacgatctaatttatatattgcatcacaatttaatcaggaaattgaaaagattacgatcaaggaagatggatacaagattaatttttatatgcttccatttgtaaagccagcgtatatcaatcatgtattaaaaattcagacagaaacctatgaagaatgcttcaagcatctaatggaacaagtgaagatcaaagaagatgagacgaatatcctgctggcgcatcagtttgtaacggttggaaagaattctccagaattgtcagattcagaaacaagcagccttggagggattgataatattgattatcgtctatttgatgcatttgactatgtagcacttggacatatccacaagccgcaggcaatgggacgtgaaatggtaaggtatgctggatcaatcttaaaatattctttttcagaaattcacaaagacaaacaggcaacgatccttacgatcagtaaaaacaagcagatttccctatcccatcatttgctaaaaccattacgtgatatgagggaaatggaatgttcgttagaatcattgttaaaaagaaaatgtgaaattggaaatgaagaagattatatgcatgtcattctgacggatgaggagcagattttagatgcgatcgggaaagtacgtacggtttatccgaatgttatgcagatcagttttaaaaaccgtcgtcatatgatgcaatatgaaaccattcagatgaaagaaaaccagatcgcagatcaaaatccaatggaattatttgaacagttttataaaatgcaaaatcatattgatctggatgaaaaaagagcacagatggcaatatccatttttgaggaggtgattcgttgagaccgcaaaaattaatattatctgcatttggaccatttgcagaggaaacagtgattgattttaccagatttaaagatgggatttttttgatctcaggagaaacaggtgcagggaaaacgactatttttgatggaatctgttttgctttatacggtgagccaagtggttcttatcgaaaacaggatatgctaagaagtgattttgccaaagatgacacagagacgaaagtggtattcttattttcgcatcgcaaaaagcagtacaagatcgaaagaaatccatcctatatgcgaaagagcaaacgaggagacaaaatgacacgacagtctccgtatgcagtattgtatcaagaagatgagattgtaacaacaggaagtcagcaagtgaccgcgcagatggaagaaattcttggaatggaccgtatgcagtatcagcagatttcaatgatcgcacaaggagaatttttaaaacttctttacgcgaaaggaaaagaacggagtgaaatctttcgtaagatttttggaacatggtatctgtatgaatttcaggaaaagatcaaacgtagacatctttcttgtaaatacgaatatgagaatcttgggaataccttgttagagcaggaagataacatttttgtatcaaaagatgcagaagaatatgaagaatatacacggtatttaaaacaaaaacatcaaattgtagaatttatggatgtagtaaaaagatatcagtatcgaaaacaacaagaatatgagaatttccagaaacaaaaagaaacacaagaagaactatatcagaagcaacggattgttttttcacagataacggagaagagacagaagatcaaagatgtaaaagaagaaattaaagaacttatagtacaaggaaaagaaaataaagcagaacagcgaacgatcaaaaaagaatatgatcagattcaaaaggaactgccgaaactacataaaaaggaattaaggtttcaagaactacaaaaacagataaaacaatataaagagctggaagcattagagaaaaaaaaggaatctttaaagaatgcgaaagaacgtatgataagacagcaggaagaaacggagcaaaaaaaagagaacgaaagacaaagagaattaaaactgctagaatttcttagacaggcagatgagattgaaacacaatacgatcatttgcaaaaagaagaattgaaacttcatgttcagacaggaaaaaatcatgaattgtgtaaggagaaagaagcttattttgagaaacttcagatttatgaagaggctggagaagtctatgataagatcagaatgcaaagaaaagaatacagagatcgattgtcagactggcaggatcgatatgactgtaatcaagcaggacttctggcaagaaatctgatagacggtcatccatgtccggtttgtggatcattacatcatccaaaaacagcagattttaaagaaagtgatattacgcaggagatgcttcgtgcacttcgtgaagaaacggaattgatcgatcggcaatataatactgcatttgcgaaagtaaaacagagtaaaggtattgttgagacatgtaaagaacagctttgcaaaaaaagtgggaaaagatcagaagagtttgaaaagcttgacgagatctatgaaatctctttacgacaatataaaaaagtaaaaaaagaatttgaaagaatcaaaaaacagaaagaaaagatagcagaacaaagagtaaaagttgaaaaatccaaagaaagacaattgaactatgtggaaaaactgcaggaaattgccggaaaatcacatgaaaaagatagtttatataagcagacagaagccagaatagaagaaatctgtaagaatcttgaatataaaacatataaagatgccagtaaagaacagcagcgattatctgatgagatcgatcagatgaaatttaataaagaagaaatagaaaagaaaaaagaaagtgttgaaatacagggagttcatatcaaagcggccattgaagaaaaagaaaatacactttcgagtgttacaaaacagttggaagaacacaaagagatgaatgaagaaatttcagattttagaaaatttgaaacaaaacttcatcagatgaaaaaagaaatacaaaaacaaaatcagaatctggaacaattaaatcaacatatctctgtaaacgaacaatcgataagatttatggacaagaagatggaagagtataaagaagcagaaatgaactatacactgttaaaagatctgtcagatacagcaaatggagaacaaaaaggaaagacaaagatttcatttgaacgttttgtacagtcagtatattttgatctgatcttggcagcagccaatgaacggttgtccgttatgagtgaacaaagatattatctgcttcgaaaagaagaaaatgatataaacaaaggatcttctggtctggaattggagattctcgatgaatggacaggaaaaagaagaaatgtaagatcattatctggaggagaatcatttaaagcagcattatctcttgcgttaggattaagtgatgtgatccagaacaaaaaaggcgggatacaggttgatacgatctttattgatgagggatttggtactttagatgcggattctttaaataaggcgatgcagatcataaattcactgtctttggaaggaaataagctggttggcataatttcacatgtcgatgaattgaaagatcagatcgatcaaaagattgaagtttataaagatcatgcaggaagtaaaataaaaaggaattgcaaattcttatgacaggaagtcgaagacatgatatactaggaaagaaagaaaataatctgtcaaacattagagcattgtacagatttgagaacagagaggagctgatgcatgccgaagcagatcagattgttgtgacaacaacagagttactggatgtcatatggaatcatcgaagtgagaaattatatatttaacaatttacgcagcgaaatatgacatagattttaaaaaatagaattaattttgtcgaattatgtcgaatcctttggaaatcaaccaaaacttgcgaagaaatatgggttgtttgtaaacttaaatcaaatatataattaatttgtagagaaaaacagaatgggaggactgaagatgaacaagattaatgtggctattgcagatgacaaccagagaactgttgagatgatgacagaactgttagagcaggaaagtgatattgaagtaatcgcaagtgcggatgatggagaagaagcattgcgtatcatcaaggaaaaacaaccggatgttgtattactggatatcattatgccgaaactcgatggaattggtgtattagaacgtttgcaaacagaagatctaagtaaaagaccgatcattattatggtctccgcaatggggcaggaaaatgtctgcgaagaggctatggaattaggagcatcttattttattttaaagccgtttgatctaagaacgatcattaagcagatcaagcaggcaaagataaaacagcagattcctgaaagaccattcgtttctgtaccagagaagattcatggattgacagaaaaccagttggagatcatcataacgaatatgattcatgagatcggggttccggctcatatcaaaggttatcagtacttaagagattcgatcatgatggcagtctgtgatatggatattttaaattccataacaaaacagctgtatccgtcaatcgcacagaagtttgatacgacaccaagcagggtagaacgagcgatcagacatgcgatcgaggttgcctggggaagaggaaatatggacacgatcgatgcattgtttggctatacgattcatgcaggaaaaggaaaacctacgaattcagagtttattgcattgatcgcggataaaatacgcctggaatatggagatgaagtactgatcgaggaaaaataacagcataagacatcataatcatgatcaggaggttgaaaaagttggaaaagaagttaaatattttaattgtggatggggacgtatcagaagcagaggagttagaaaatgaactgaatagagagtttgatattgttggaacagtattcgatggaatgaaagcagttgatgagatcattagaaagaaaccagaagttgtcttaattgatatcatgctgccatatatcgatggagtcggggtgatcgaaaaatgcagagaatgtatggaatatgaacaattaccagtatttattgttttaacatcgatcggtaccgagaaattgatcgaatgcgtcaatcatatggacattgattattgcattgatcgcggataaactaagactcgattatcatatgaatgcatcttaagatgatgatgatgagataatataagatgcatatggacgaatacagggagattgtctgaaggagaaaatatggatgaaagacatagagttttaattgcagacagttatccggacgaggcagaacaattaaagaaagaattatcaggaaaatataatgtaatatcagtaagagataatggggtggatacattggatgatattataaaattaaaacctgatcttgtagttattgatctgatgctttcagagattgacggaattggtgtaatcgaaaaatgcagggaattgatagaaccagataaaattccagcatttattgcattaacaatgctcgaaaatagagatctgatggagtgtatcagacggttaaaagttgattattgtatgatgaaaccgtttcaggcaggaattcttgcagagagaatttcacagatgatacggatacgttcagtaaataatgatattcaaaaaaatgagaaagcattgcatggtcgatcaaaaagaatgtgtagcatgtgtggaacgaatgatgttcgaaggcagattagctttttggttaggaatttaggggtgcctgcacatattaaagggtgccgttatatgaaatatgcgattctaatggcgatagaagactgtaatcgtataaattatattacaaaattattataccctgagattgcaaagaaatgtaaaacaacgaccagtagtgttgaacgggcgatccgccatgcgatcgatattgtatggatcaaaggaaatcaagaacttttaaaagagatttttggaacatttgtgatggaaggacaggaacgtccgacaaattcacaatttattgcagcagttgcagattggatgcggctggaacatcagataaaagtttcataagaatgaaaatattttggaggataagatgaaagaatatattcctgattattataaggattttcagtgcattgcagataaatgcaaagatagttgctgcattggatgggagatcatgatcgattctaagtcctataaaaaatatcagaatgttaaaggagaatttcatgacagactgatgaaaggcattgatcacgaaggcactccagcatttcatcttgatgatcgcgaccgctgtgtgtttttgaatcagaaaaatttatgtgatatttatattgaattaggagaagacgctttgtgtgagatatgtacacaacatccgagatttcataatgaatatggaaatattcgtcagacaggtcttggaatggcatgcgaagaagctacacggctgatgtttgagacaaaggaatttggattatgccagattcagggaacgaatacagagtcaacggatgactttgatgaatcagttttagaaattcaattatggatattggatttgctgaaaaagaaagaaaacccagtggaacaaagaatagaacagatatttgatgtggtgcagggaatccaggatcatttgaaccaaacgggtgagattctgaatacatggaaaaatgatcctataaagaagaatcatatattaagtcaaatgcgagaagaaacatatatcaaaaactggatatctatatatcaggaattagattttatggagccaaagattcagaagatgttttgcaagatggaaccaatgccatgcatgatcaaagaacaagaaatcgatgagtcatatatggaacatttgatgagttattttatttatcgttattttatgaaatcctgtgaagataataatctgatcgataaagttaagttcgcaattttaagctgtttgataattgaacagatgaatgaatattgtaagagaaatcatattttgaagacaccgcaggagattgctcgaatttactcaaaagagattgaatattcgcaagaaaacatggaaatcatttttgaagagctattatttggatagatcattatacaaacatttgtaatagaacaatatatctttataatagttcagaaaaaaacaatttaagaaaattgaaagtgaaatattatgagaattcgaaagagaaaaccaatagggaaaaagacgatcaaatacatagagaaattgtatgaggcatattcaaggaagttattttgtattgcaaagaatcatgtgaaagacgatgatctagcacaagacgtggtgcaaagtgtatttgaaaaagcattggtatatccggaaagtattttgaaggtgccagaggaagaagtattttattttcttacgacaataacaaagaatgaatcctttacattgttgaaaaatgaaaagaataatgaacacgagagtcttacatatgaagatggatcagaaggggattttgttgaagatcctagagataattatctgcagatgatcgatctggaatctttaaaacagaatctggcggcattaccacgaagacatcgagatacgattttatttcgatatgtttatggattgaaatgtaaagaaattgcagatttatttagaattacagagcgaagtgttaaaaatcgctgcagagaagcaagggaactgctcaggcagatgatgggagcagacgaattgtaattaggattaatataaaaaggttagcagtgtgatcatactgctaacctcagactgtagacaaagtcccggtatttgccgggactttcagactgtagacaaagtcccggtatttgccgggacttttactatgagcactgtttttctggtataataaaattatcagaaaggcggtgttttttatgatgacgaaaaatgcagacaagaaacgagaacagatgatgatgttctcaatggattccatggttccgcaggatcatatgctaagattgattgataaagcaatcaactggaactttatttacgatcttgtagaagataaatattgtcaaaacaatggtcgtccaagtatggatcctgttatgctcattaaaattccatttattcaatatctttatggaatcaaaagtatgcgtcagacgatccgagagattgaagtaaatgttgcctaccgttggtttcttggtctggatatgctggatcctgtaccgcatttttcaacgtttggaaagaattattcccgccgatttaaagacacggatctttttgaacagatattttcaaagattctggaagaatgtatgaagtataagttgatcaatacggacgagatctttgttgatgcaactcatgtaaaagcatgtgccaacagtaaaaaaatgcgaaaaagagttgctcatgaacaggcactctggtatgaagatgaattacaaaaagagatcaatgaagaccgacaggcacatgggaaaaaacctctaaaagataaaaataagaagaatccgccaacacctcccacatctaggaatgatcaacataatgagcttgaacagataccagacgatataaaaaccaaaaagagcagtattacagatccagaaagcggatggtttcgcaaaggagaacataaacatgtttttgcatatgcagtagaaacggcatgtgatgaacacggatgggtccttggatatagtgttcatcctggaaatgaacatgacagccgaacatttcaaacaatctatgaaaaggtgaaaagttttgaaccagaaatgatcgtggcagatgcaggatacaagacaccagcgattgccagacaacttctgaaagataggattgaaccattgtttccatataaacgtcctatgacaaaagagggattttttaagaaatatgaatatgtttatgatgaatactatgattgttacatctgtccagaaaatcagattctaagatacagtacaacaaacagggatggatacagagaatataaaagctgtggatatcaatgtgaaaaatgtccacagatatccaaatgtacagaaagcaagaatcatgtaaaagtgataacacgtcatgtttgggaaaaatatatagaaaaagcagaagatatccgacatgtaagagggaataaagcaatctatcagaaacgaaaagaaacgatagaaagaatctttggaacagcaaaagaacaccatggatttcgatatacacaatacataggaaaagcacggatggaaatgaaagccgggcttacttttgcatgtatgaatctaaaaaaactggcaagatttcttggtaagaacggattgctaaatgaacaaaagcgaagatttctaagaaatttttggatacaatttaactttaaaggaaaaaatggtgctgggatgatcccagcacctagtttgtctacagtctgaggttagcagtgtgatcatactgctaaccttttatatttattgatttgttgtatttttcatgagtttagatccgacttcttcataattgtctgggaagaagatatgaagggtatttttaccgcttttgatcttctgtagttttaatttaaatgtttgtgtatgcatatcagaggatacatcagcagaattgaaagcttcgaccacattggatactaattgtttctttgcatcggataagttctcaatgtgaagaggttttaattcatctaaagtagtctgttttgcttgtttaaaaatatccagataattgatgtattggctagacaccttaactgttgcatttttcttatcttgacctgttaccgtgatcttgtggtctaaggaagaaagtttgctgctgatcgctttatagatctcatttgcttgtttcttagtgatcgtaacgcctgcattcttaaaactcttctgaagagttgatatcatggatatctgatatgtttttaaagtatcagatgcttcagaatcatcaattccaagatctgtcatcgatgttgtatcttgttttatgatcagatcatagaatgcctccatggtgtcatcaggttttgagtcacttgtgctctgtccacatccagcaagggataacagtaataagatccctaatataccggataggaactgtttgaaaatcctacgtttcatacttattgttcctttctactttattcatatctcattatagagattttggcaggtaaagtcaattactgtcgaatgatggctataagaaacagctcaattgacgaagaagatcattgtgtgatacactagataaccgaaagataaaaaggagagttgtgtatttatggcgaataaaacctatgatgctaacagcatttcagtattagaaggactggaggctgttagaaaacgccctgggatgtacattggaagtgtatctacgaagggattgaatcatttaatatatgagatagtagacaattcggtcgatgaatttctggcaggatattgtgatgagatcacagtatctttaaataaagatggaacagcaactattacggacaatggacgaggaattccggtcggaattaatgaaagaacaggaaaaacagcggtagagatggtatttaccatgttacatgcaggaggtaagtttggagatggaggatataagatttctggaggactgcatggagttggtgcatccgttgttaatgccctttcaacatggcttacggtaactgtaaaacaaggaggaaagatttaccagcagagatatgagcgtggaaagatcataacacctcttgaggtgatcggtacctgtagaaaatcagatacgggaacaaacgtccagtttttaccagacccagagatttttgataagacatattttaaagcagcaatggttagaaaccgtttgcatgagactgcgtatttgaatcccaaacttacgattcattatgtgaatgaacgagaaggtgaagaaacaacagttgattatcatgagccagaaggaatctgcgcttatgtaaagaaattaaatgaaggaaaacaaatgcttcatgaaccagtatattttaaaagaatgattgatggaattgaggcagaagtggcatttcagtatacagaggattttggggagaatattctgggattttgtaataacatttatacgatcgaaggtggaacacatatcacagggtttaagacgaaattcactacgatcatgaatcaatatgccagagagatcggggtattaaaagaaaaagattcgaattttaccggaacagatgtgagaaatggtatgacagcgatcgtttccgtcaaacatccagaaccaagatttgaaggacagacgaagacgaaactggataatccagatgcagccaaagcagttggagagatcgcgggagaagaattggttctttattttgataagaatctagatactttaaaaaaagtgctggcatgtgcggaaaaatcagcgaagatccgtaaagcggaagaaaaagcgaagacgaatatgctggtaaaacagaagttgtcaattgacagcaacggaaaactggcgaactgtgaaagtcgtaaagcacaagactgtgagatttttattgtcgagggagattctgctggtggttctgcaaaaacagcaagaaaccgaaagacacaggcaatccttccaattcgaggaaaaatcttaaatgtagagaaagctacgatggataaagttcttgcaaatgcagaaattaaaacgatgatcaatgcatttggatgtggtttttctgaaggatatggaaatgattttgatattagtaagcttcgttatcacaagatcattattatgacagatgctgatgtggatggtgcacatatcgcaacattgcttttgacgttcttttatcgttttatgccagaattgatcacgcatggacatgtatttcttgcaacaccgccgctttacaaagcaatgcccaaaaagggcgaagaaacttatctgtttgatgatgcagcactgacaagatatcgtgcagaacataagggaaactttactttacaacgttataaaggtttaggagagatggatgcgcaacagttatgggagacaacgctgaatccagaaagtcgcacattaaaacagattgagatcgaagatgctagaatggcctccgatgttacttctatgctgatgggaagcgacgtaccacctcgcagacagttcatttatgaaaatgcaaatgaagcgatgttagatatataaatagaaaggaaacaatagataatgtcagaacatattattaaagcagaattttctgaggttatgcaaaaatcatatatcgattatgcgatgagtgttatttgtgcaagagcacttccagatgccagagatggattaaagccagtacagagaagagttttatattccatggatgaattaggacttcgttatgacaggccacatcgaaaatctgcaagaatcgtcggggataccatgggtaaatatcatccacatggtgacagttccatctacgaatccctagttgttatgtctcaggatttcaaaaaaggagtccctcttgttgatggacatggaaactttggttccatagagggagacggcgctgcggctatgcgatatacagaagcacgacttcagaagatcacgcaggaagcatatcttgcagaccttgataaaaatgtagttgattttgtatcgaactttgatgaaacagaaaaagaacctgaagtacttccagttaaggtgccaaacttattggtaaatggagcagatggaatcgctgttggtatgacaacgagtattccaccacataatttaggggaagttgttgatgcagtgaaagcatatatgcgaaaagaaagcatcacaaacgaagaactcatggaatatatagaaggtccggattttccaacaggcggccttgtgatcaataagaaagatttgttaaatatttattcttcaggaacaggtaaattaaaattaagaggaaaagtaacttttgaaccagcaaagaaacgtggggaaaaagataaactggtaatttcagaaattccatacacaatgatcggaaataatatttccaagtttttatcagataccgtagcactcatagagaacaaagtgacaacagatattttggatatttccaatgaatcctctaaagatggaatccgaattgtattagaacttcgaaagggtgcagatgttgaacgcttaaaaaatcttttatataagaaaacaaaacttgaggatacatttggtgtgaatatgctggcgatcgttgatggacgtccggagacactggatcttaagggaatcattgaaaatcatgcgcagttttattatgaagtaacaagaagaaaatataaaacattactatcaaaattatatgaacaaagagaaattaaagaagggttgatcaaagcatgtgatatgatcgatctgatcattgaaatcattcgtggaagtaagagtcagaaggaagtaaaggcatgccttaccaaaggagatgttggaaatattaatttcaagtcttcagattctatgatcgaagcaaccaagctttcttttacagacaaacaggcaagtgcgatccttgatcttaaattataccgattgatcggattagagattttgatgttaaaagaagaatatgaagagattcttgcaaagatcgaagaatatgaagatatcttaaataacgaaaaatctttaaagaacgtgattcgtaaagaattagataagattaaaaaagaatttggacgcgaaagaagaactgtggtcgaagatggaaaagaggcagtttatgttgctgcaccagtcaaagaagagacggtttattttgtgatggatcgttttggatattccaagacaatggataaggcaacttatcagagaaataaggaaaatatcttaaaagaatacaagtttattgtgccttgtatgaatacagataagatttgtatctttaccaatcttggtgtgatgcaccagatcaaggtactggatattccagccggaaaattcagggataaaggggtaccaattgataatttatgtaattatgacagtacaaaagaatatatcatccaggtgctggatgcagaatcaatgattcattcatcacttttatttgcaacagcaaaaagtatgttaaaagtgatggatggagagttgttaaatgcagcaaagagaactgtgcaggcaacaaaattatcggaagatgagctgatcgaagtgattccgatagactggatggaaggatccgaagacaaagtagtccttcagacgaaagaaggagttttcttaaaattcttgctttccgagattccaaaaaagaagaagagtgcattaggtgttcgtggaatgaagttatcaaaagatgattcactaacgaatatttatgtgatggcagcacagaatatcagttctatcgtatataaagaaaaagaactggaatttcatcggttaaaactatcaaaaagagatagcaaaggaactaaagtccgcagatagatctaagatagaaaggaaaaatcatggtaattgacttgatcataccaacatataagccaagagataagtttcaggaatcattaaaacgacttgcattgcagacaagaaaaccagaccgcattattttagttaacacagaggcagaattttttgacgaggaaatgatcactccatatgataatgtagaagttcatcatattaaaaaagaagaatttgatcatgggaaaacaagagattatggagcatcgcttgccaaagaagctgacattttaatgtttatgacagatgatgcgattccaaaagataaatatatggtggaaaatctgatcaaagcatttgatgatccaatagtaacagctgcttatggaaggcagatggctgatcctgaaaaaaattatattgagtattatacaagaatctttaattatcctctggaaagcagagttaaaacaaaagaggatctggatactctggggatcaaaacatttttttgttcaaatgtatgcagtgcttatcgaagatcagagtatgatgcaatgggaggtttcgagcataaaacaatctttaacgaggacatgatcatggcttcaaagatgatcgaagatggaaaggcagttgcctatcaggcagatgcaagggtatggcattggcatgattacaaggcgatacaacagttacataggaatttcgatcttgcagtgtcacaagtagatcatggaggattattccttaaagtgagatcagaatcagaaggtgtaaaaatggttatcgcaacgatcaagcatcttttcaaaaaaggaaaactatatctcattccaaagtatgtgatcgatacaggatttaaattgatcggatataaacttggaagaaattataaaaaactgccaaaatggatggttttaaagcttacgatgaatcagacttattggaaagcttaacaaaaacttaataaaatcacctactgtttttttgtatgatatgatataatctacaatgataagcagataattgtgaggaggacacgaatgaagattaagaagtttaaaattatcctaagtctgtttttgatcataggaattgctgcagggggagtgcttggatattatgatgcaagattagaagcagcagtgaataataagaatggaagtacactgacagacgtaaaggtagatgataatctgacatttaataagaatgttattaatatcttattggttggatctgatcatggagcgatcaaaggtgatcacggaagatctgacagtattatgatcgcaacggtcaattttaagacaaaagaattaaagctcacttctttgatgagagatatgtatgttgagattccaggacatggacataacaagttaaatgcagcctatgcatttggtggtgtagaattattataccagacgatcgctaagaactttgggattaagatcgacaattattgtgttgttgatttctcaacatttgagaaagttatcaataaagttggcggtgtagaaatttcgctggaagaaaaagaagcaaaatacttgaatacaacaaattacatttcaaagaagaaataccgtaatgtaaaggttgggaaacagacattgaatggaaatcaggcattaggatatgccagggttcgttacgttgtttctaagaaatacggagatggagactttggaagaacaggtcgtcaaagagcagtacttcaagcagcacttaataaagtattgcagcagagcccaacaaagatcgcagatattgcgttagattcattagccgatgtatcaacagatatgagtgcaaaatacctgaagagtctggtattgaaagttattcagatggggacgacagaaatcgaccagatgagggtgccgttagaaggtacttataagatgggaagagcacagagcaatatgttcgtattctttataaacttcagtgccaataaagcagccatgaattatttcttatttgacaaaggcagtgaaaaagactgggcaaaagaatatggaggaatatcttctgttgagacatttggatattccggaacatcatcatctgactcaacaagcagcagttcatcatattcaacatctagtacaagaagcagctatcagcaggaaagttacagcacaacaagcagcagccatacgacttatagtacaaggtctacaactacgagaagtacagaagaacgtgtgacagaaagtacaacgtcacagccacagacatctgcaccaagaccaaccacagcacatcatacaacgacagctgcggcgacagaatcaacaccttctgatgattctgttgaagaagaataaacaaaaataaattaaaatgaaaatgtgtcaaggtagaatcactgtcatatcatattctttcttgacacatatttgtataattggtagaataagaaaagttaccaataccctgtaatataccattacggtgatagaataagacaaagaaaggaaataaaagatatgcgacagatcgttctttctattttagtagagaatactcccggggtattaagccgaatttctggtttatttacaagaagagggtataacatagacagcatcacagcatgtacgacacaagatcagaagttttcaagaattacgatcgcagtcagcggtgatgatatgatcttgaaacagatcaagaatcaactttcaaaactggaagatgttgtgaagatttttgaactggaaaacagtaagtctgtttgcagagaattgatccttgcaaagatccgtgcaaacaagacagagaaacaggaggttatcacgattgcagatattttcagagcgaaagttgtggatgtatctaaggataatctgatgatcgagttaactgggaatgtgaataagatagaagcatttatcaatctgatcagtgattttggagtgatcgaaattgtgagaacaggaatcactggtttatcaagaggagaagataactctaatatattttgatgagagtaacgggtcaggacccttactataaagccaaaaaaatggaggaatgaaaaatggcaaagatttattatcaagaagactgtaacttatcacttttagatggaaaaaccatcgctattatcggttatggaagccagggacatgcacatgcccttaacttaaaagagtctggatgcaatgttatcatcggtctttatgaaggaagcagatcttggaagagagcagaagaacagggatttgaagtgtacacatctgcagaagctgctaagaaagctgatatcatcatgattctgatcaacgatgaaaaacaggctaaattatacaaagaaagcatcgaaccaaacttagagccaggaaatatgttaatgttcgctcatggtttcaatatccacttcggatgcattacacctccaaaagatgtggatgtaactatgatcgcacctaaagctccaggacatactgtaagaagcgaatatcaggcaggaaaaggaactccttgcttagtagctgttgaacaggatgctacaggtaaagcattagatttagcacttgcttattctttaggaattggtggagcaagagctggtgttcttgaaactacattcagaacagaaacagaaacagaccttttcggagaacaggcagtactttgcggtggtgtttgtgcattaatgcaggctggtttcgaaacattagtagaagctggatatgatccaagaaacgcttacttcgagtgtatccatgaaatgaaactgatcgtagacttaatctaccagtcaggattcgaaggaatgagatattctatctctaacacagctgaatatggtgattacatcacaggacctaagatcatcacagaagatactaagaaagctatgaaacaggttcttacagatattcaggacggaacattcgctaaagacttcttattagatatgtctgatgcaggatctcaggttcacttcaaagctatgagaaaattagctgctgaacatcagtctgaagttgtcggaaaagaaatccgtagcttatacagctggagcaacgaagataaattaatcaacaactaggatttatttatcttacataaggatataaaagatcagagatttttaatttctgatctttttctttatgtaggaatatttaaagaaaataataccttaaaggaagggaaagcaatgaaatttgtaattcagagagtaaaagaagcatcggtaaaagtagatgatgaatacacagggaagataaaaaaaggatatttagttttgatcggtgtagggcaggaagatacaaaagaagaagccgataaatatattcgtaagatgatcaatcttcgtatttttgaagatgaaaatggaaaaacaaattgttcattaaaagatgtggatggagaattgttgttagtatctcagtttacgctttatgcaagctgcagaaaaggaaatcgtccaagttttacacaggcaggagatccaaagaaagcagaagaattatatgaatatatcattaaggaatgcaacaaggaaatagatgttgtacagacaggtatttttggagcacatatggaagttgctttaataaatgatggaccatttacggttgtccttgaagatctatagtggtaaaataaaagtgacaaatgatcatgctaaattatagaaaggatgatgacatatggatttcacaaatggaatgaaaaaagtatttcttgcaagtgtaggtgcagcagcaacaactgcagaagttaccaaagacattcttgagaaaatgattgaaaagggtgaacgtactgtagaacatggaaaagtgttaaatcaggaattaaagcacaatgcaaaacagaaagtcaaagaacatgtatctatccaagtgactaagaaatatgataaagcatttgaatgtgttgatgaaatgtccccagaagatcttgcacttttaaaagaaagaattgcaaaagccgaggcacttcagaaagaaaaacaggaagctgaagaagatgttgaagtggaagaaagtgaagcaacaacagattcagagacatcacaagtacaagaggatgaaactgaacaataagaggtacttatgaaacaggaaacaggaagactgaaagagatcttgcatgtattaaatcagcataatgtcacacatgggatcaatccagagaagttatgcagtattttagaagatcttggtccaacttatgtaaagcttgggcagatcatgtcaatgcgttcggatatattgccagagaagtattgtcatgagttagcgagacttcgtacggatgtaaaaccgatgagttttaatgagatatggaagatcttgaataaagaacttcataatgaccccggtcaactatttcagaagattaaccagataccagttgggtgtgcatcaatcgcacaggtccatgaggccgttttaggagatggcagtaaagttgtattaaaaatccagagaccgcagattaaacagatcatggcagaagatattgctctgttaaagaaggcttctggatttttaaattttgcaacaggaaccggtgaattgattgattttagaaaagttattgatgagttgtgggagacatccaaagaagaaatggattttgaaaaagaagcacaacatttggaacgattttatgagaaccagaaggacgttgcatatgtgacatgtccgaaagtatataaggaatattcgaatgagcatttgctggtgatgagttatgttgatggaatccagatcgaccatatcgaggaacttgatcgcaatgggtatgataggaaggagattgcccagaaaacagcacaaaactattgtaaacagattttggcggatggtttttttcatgcagatccacatccagggaatctatggattagtggtggtcagatcgtatggcttgatcttggaatggcaggtgatctatctgaacattaccgtgcgatcatgaaacgtgcgatcacagctattcttaaaaatgatatttatgaacttaagaatgcattcttatcgtttggaaaaccgacagagaagatcgaccatgctagtttgtatacggatcttgatgatatggttggaaaatacatgaatatggatttcgggaccatggatcttggagaattgatggaagatgcaatagggcttttgaagaaacataagattgcgatcgaaccagatattacgctgcttgcaagaagtatggtgactatggaaggaacattgaaattatgttctccagaagtgaatatgatacagatattgacttcttatatgtctgcgaatatgtttcatgagattgatataaagaaagagataagacatgctttgagagatatttatgggtcatctaagaaatctttggagataccagcacaggtatcagatcttttgaacattacaaagaatggacaggtaagggtaaacattgaatctgcgcagatcgagaaagcaggcagagaattaaaaaaaggatttgatcatctgttgcttgtattgatcgtgatggcactttggtttagctctgcaattttatgtctaagtgatgtaacaccgagagtgttaggaatgccatatcttagtgtggcaggatttatatcagggtttctgattgttttgtatgtattgatccatatgctgattcagagaaagaaataagaataatgataaaacaaataggaacattaaatattgagattgagcgaaggaagattaaaaatataaatatctacgtgaaacctccaaacggagatgttttggtaacagttccaatgagagtttccaacgaagaggtttttcgtttccttaagaaaaaagaagagtggattttaaaaaaccatgaaaaagtaaaaaacagacaaaattcatcacagcaggaaattaatctggaacaaaggaaatggctggaagacaagatcatagaatatgcaatgagatgggaatcgatcatgaaagttcatgcgaatggttttacggttcgagatatgaaaacaagatggggaagctgtagtattcacagtaaaaagattcggatgaatctgcagctggctgtaaaatcagaggaatgtgtagagtatgttttggtgcatgaattatgtcatcttttagaaccaagccataaccagagattttatgatttgatgagtcattttcttccagattggagggaacgtaagcagaaactaaatgaaaaagtgtgaagaaagtgttaaaatccattttttatcttacattttctattaatttgagttatgataaaacgtaaagctcaaaagaaggagaaaagacgataacgaatgatgaataacgaaatgacaaaatcaaacgaacaaaatatattagtcgggatcgacgtaggatctacgacaaccaaaatagtagcagttgatgccaatgaccgtcatcaactgttattttctgattatgcaagacatcatgcaaatcagatcgcaagtgtgatccgaagcattaagaagttttgcggacatataagagataagaagatcagattgtgtctgactggttctggggcaaaaccagtggcatctattttaaaagtaccatttgtgcaggaagttgcagccaatgcgatcgcattacaagatcagtttgaccaggtcggaacggcaattgagttaggtggacaggatgccaagatgatcttttttaaagattctgaaaatggacagtcacaaagtgtttccgatatgcgtatgaatggaagctgtgcgggtggaacgggagcatttattgatgaaattgcatccgtattaaaagtaccagtggaacagtttaatgagttggcacaaaaaggaacacatttatatgatatttctggaagatgcggggtatatgcaaagacagatatccaaccacttctgaatcagggagcagccaaggaagaccttgcgttatccgcattccatgcgatcgcgaaacagacgatcggagggttggcccagggattggagattaaaaaacctgttgcatttgaaggtggtccattaacatttcatccaactctggtaaaagtttttgctgaacgtctggatttgaaagaagatgagattctttgtccaaagcattcagaattaatgattgcatatggggcagcattatctttggataagatgtttgcagacagcaaaccaaaagatgtgaataaaatgttagtaatactggaagacgcacagaaagatcattcccacgtttcaggagaaattgcaaaaccattttttgaatcaaaagaagaagaaaatgcttttaaagaagcacataagaagaaacaggtgacatggaagaaaccacaaaaaggagaggttgttcgatgttttcttgggattgatgcaggaagtaccacaacaaaatttgtattattagatgaacaagaagaaattctggattctttttatgcaccgaatgaaggggatccgctgaaagtagcgaaagaggccttgatctgtttaagaaaacgatatgaagaagcaggagcagaattagaaattttatcagctggtacgactgggtatggagaaatgctgttttccaaagcttttgaaatcccttgccatacggttgagacggtagcacatgcaagagcttctgaaaaatatgtcaaagacgcctcttttattttggatattggtggacaggatatgaaagcaatctggttagaggatggagttatcacaaatattttattaaatgaggcgtgctcttctggatgcggttcattccttgaaaacttcgcatcctctttacatattccgacaaaagagattgcaaagaaagcgtttgcgtctaaaaacccagcagttttgggtagtcgttgtacggtatttatgaacagcagtattatcacagagcagcgaaacggtaagaatccagaagatatcatggctggattatgcagatcgatcatccagaatgtatttacaaaggttatccgcgtatcaaatcttgattctcttggaactaagatcgtggtacaaggtggcacttttgaaaatgatgcggttttacgtgcgatggaagaatatgtaggaagagaagtgatcagagcaccatatccagggatcatgggtgcaattggtgtcggattgatcgcaaaagagcaatatgagaagaatccgaaagaagtgagcacatgggatcttcgtgatttagatacattttcttatgagcagcaggcgaatgcaccttgtccattttgtacgaatcattgtcaaagaacaattgttcaattttcaaatggaaattcctgggtaacaaataatcgatgtgaaaaaggcgagatcatcggagatccaagaaatgatgaggttggaaagcagttaaaagaaacaatccgaaaaacacagagtgttccagatttattccaagagcgaaagaaattattgttcaaagaatatccttatccagtgcctaaaacagaaagagatatcacgatcggaattccaagagtgttatcctattgggatacgatgccattttggacaacttttttcaaaagtttgggatacaaagtacaattatcggatgaaagcacaagagagatttatgaaagtggattgtcagcagtgacatcagacacggtatgtttcccagcaaaacttgtgcatggacatcttagaaatctggtgaaaaaatatcatgtagatcatatttttatgccatcgatcacaacagtaccgccagagaatatggaaaaaacaagtgagtctatgtgtgcggtggtaaaaggttatccgatcgttatcaggaattctgataatccacaggataaatggaatgtgccatttgatgcaccattattccattggcataccaaaaaggacagacagcgtcagttggtaaaatatatggaagaagtatatcatgtctcaaaagaagaggttatgaatgcaatgcatacagcagatcaggctcagaaatcttttgaccaacagttaaagaaacgaggagaagagatcctaaatgaagtaaaggaaaagaatgaatttgcagttgttttagcatctcgtccatatcagaacgatacactggttaatcacgatctgtctaagatgtttacaaaagcaggcatcgcagtcttaaccgcagattccctgccagaagtgaatcagacagaactctcaaaaagccgtctggatattgtaaataactatcatgctagaatgttatcttctgctatcttatgtgcgcaaagtgagcatctggaatatgtacagctcgtaagttttggatgtggacacgatgcttatctatccgatgagattacgagaatgatgaaagaaatttccgggaaaacaccattgatcttaaaagtagatgaaagtgataatcaaggaccattgggaatccgtgtgcgttctttcttggagacagtgaaaatgggacatgagaaacatcagaaattagaagtaaaagagttgcaagaaccatatccagtcaagtttacaaaagaaaacaggaaagaaaaaatcgcattggttccaaatacatcgcatgcattttgcagaattatgacagcagcattaagaggacaaggaattcgggcagttgctttggatatcgggcgtgaagaagcaattcgtttgggaaagaaatatgtacataatgatatttgtttcccagcacagatcgtcatcggagaagcattggcggcactggaaagtggaaagtatgatgacaaagatgttgcgatcgttatggggaaatatgtcggagactgtcgactgacacattatggggcactactaagaaaagctcttgatgatgcaggatatgatcatattccgatcctgacaaatgatgatgcagattctcataatatgcacccaggatttaaattaaatctggcatcttctgtaaaaatcgcatttgcattaccgatgatcgatgtattggaggaattattacgaaagatccgtccatatgaaacagtcaaaggaagtgcggatgaagcgtttgacaaagcccttgatcttgtaatcgatggattggaaaagtcaggagttcttggtgcaagaaaaggatttaagaaggctatttctatcatgaaaaatatttcttatgatcgtacgaatttaaaaccacagattctgatcgttggggaatatcttctgaacttccatccaggagcaaaccatgacattgaaaaatatctggaagaaaatggatttgagatcattgaagcacgtatgacggatgttatccgtaagacatacttttatcaggattcacagatcaaggaatatcatttaaataaaccaatggatcaaaagatctggtttcggacagcagacatgttctttgatcttgcacacagcctgaccgattccattgcaaaaggacatcctttatataaaccagcgatccgtatggatgatctggtaaaagacagtgatccgatcattcatcatacatttgatgcaggagagggtgtgctgattccaggagagatcattcatcacgcaaaacatggatgcaagtatttcttgatcttacagccatttggatgcctgccaaaccatgttgttggaagaggtatttctaagaagttaaaagaaatgtatccgaatgcgcagattcttccattagactatgatccagatgtcagttttgcgaatatcgaaaatcgtctgcagatgcttgttatgaatgcgaaacaagaaatcttggaagaaaatgaagaacgagaccgtagaagaagtcatcactacatggaaagtgacaaaaaaacatatcgtagaaagaaatatggtgtcgaaaaaacttctggtgtataaaatatagaattaaattgttgaattttattaaatatgctataatccattttaggttattcaaaaataatttgtatggaggagtattaatgaatattcaggagttttatgacagtattgatgaaagttatgaaaatgtaagcagccgtatgatgggaaaccagaaactggtggaaaagtttgtccgtaagtttttagatgatcctacttatgaacagattaaagaagcagtagataagatggattatgatgaaattcttcgaacaactcatacgatgaaaggaattgcaagcaatctggagtttacacatttacagcaaaaaagtgcgaaagcagtagatatgatccgtgcaggacagcgcgaagaagtattgccagtgatcggtgaaattgagaaagaatatcaaaaagttatcgaacagatccagaaattggattaaattggataataagaagacaaagatgagggaatctttcgaagtagtatgaaggagacagcgacaacataaaaataaaaaggaactagcgattatgcaaaacaaaacaaaaaatatattttttaagataatctcaggactcgttttgattcagggtgtgttgcagttattgaatctgttagggcttgtaggttatggaagaacgacgacttctgcaacaaagttttatcttggacttgttttgatcggcggctacgcagtagcagcaatggtcggtggatatacgggtcttaaagatggaaatacacaggaaggatgtaaaagatgtttttatgtcagtcttgtactgatcgcaattacgattgccacgattattttaaatgttgtatttaaagcatattcagtaactcagtttgaggcactgatcataccagtgttgtttatgctttttacaatattaaatggacgaaagaatttgtaaacacaaaagggcctttttcgatttcgaaagaggtcctttttatagttgttcttttcttgatgatatgatataatttcacatagtgatttggcaaagaaagaacaaatgaggtagaccaatgaaagatttaaaagatatgaaacgtgtgcttttaaagttaagtggagaagcacttgccggagataagaagacaggatttgatgaagcaacatgtgcagatgcagcgcgtcaggtaaagacgttagtagatgagggacttcaggtagcgatcgttatcggaggaggaaacttctggagaggacgtacaagcgagagtatggaacgtacaaaagctgatcagatcggaatgcttgcgacagttatgaactgtatctatgtatccgatgcatttagaacagcaggaatggaaacagaagtatatactccatttgtatgcggagcatttacagaattattttccaaagataaagcagtcaaagctttagatgaaggaaaggttgtattttttgcaggaggaacaggacatccttatttctcaacagatacagcaacagcacttcgtgcgatcgagattgaagcagatgcgatcttattagcaaaatcaattgacggcgtatatgacagtgatcctgctgtgaatgaaaatgcagtgaaatatgacagtatcacaatggaagaagtgttggatcagaaattaggagtgatcgacctgacagcgacgatcatgtgccttgagaataagatgccattagcagtttttggattaaatgaagaaaacagcattgagaatttaatgaaaggtgaatttaacggaacatatgtaaccgtttgataaattaggaggacgaaagaaacatgttaaaacaatttgaagacaagatgcagaaatctttagacagtatggcgaatgattttatgacaattcgtgcaggacgtgccaatcctcatgtattagataaagtcaaagttgattattatggagttgcaactcctgtagcacaggttggtaatgtttctgtacctgaagcaagaacgatcatgattcagccatgggagccaaacttattaaaagagatcgagaaagcgattttagtatctgatatcgggatcacaccaacaaatgatggtaaagcaatccgcttaaacttcccagatcttacagaagaacgaagaaaagagcttgcaaaagatgttaagaaacgtggagaagaagcaaaggtagcagttagaaatatccgtcgtgatgcaaatgattttgtcaagaaacagaataaagccggagatttaaatgaagatcaggcaaaagatgaagaagacaaagtacagaagatgacagataaatacatcaaacagatcgatgaagcagttgatgcaaaatcaaaagaaatcatgacagtttaatcttaatcatcaacagggttgaaatctcagccctgttttgtttcatgtgaaaagaaatgaaagttatatatgatacacaggaggtccaaatggagaatttaaatattccacaacatgtggccattatcttagatgggaatggaagatgggcaaaaaaacgccatttacctaggaatatgggacatagacagggaagtaaagtggtggaaaagatcattgaagatgcacatgatcttggaattaaatatttaacagtttatgctttttcaacagagaattggaaacgcccacaggacgaagtaaatgcattgatgaaactgcttcgtgattatttaaagacatgtatcaagcgtgcaaataaaaataatatgaaagtcagagtgatcggagatatcacaggactttctgaagatttacaggagaagatcgttgagcttgagaaggcgtccaaagataatacagggatcaattttacgatcgcactgaattatggaagtcgtgatgagatggtgcgagctatgagacatatggcagatgatctttccagtggaaatctttccaaagatgagatcacagaagaagtgtttaatggatatctggatacaaaagaacttccagatccagatctgatgatccgcacaagcggggaagaaagattgtcaaactttatgttatggcagttagcatatacagaattttattttacagatgtgctctggcctgattttaataaaaaggaattaataaaggcgatcgaatactataatggacgcgaccgcagatttggaggaatataagtttatgtttaagcaaagactgatcagtgggatcattttagtattgatcgcagcttttgggttatatatgggtggaattgtgacgtttgcaatgacattgatcgttgcattgatcggatacagcgagattttaaagatttatcatattgagaaatcatctttggcagtgatcggatatacaggcacgattctttattatgtggcattgttatttgatcttgatcaatggaccacagcgatcattattttatttttaatctttttactcggatgctatgtggtacgttttccaaagtataaagtggatcagatgatggcaggattctttggatttgtatatgtagcggttatgatgtcctttatctatcagatccgtgaattacaaaatggaggagaatttgttgtattattattccttgcagcatggggaaatgacactttagcatattgtacaggaatgttgatcggaaaacataagatgtcaccaattttaagtcctaagaaaagtatagaaggtttggttggcggaattgtcggtgcggcaattcttggtgcattatatggattatatctaaacacatatatcagatttagttttaatccagttacaatgttcccaattgtttgtggactaggtggagcagtttcagtcattggagatttggcagcatctgcgatcaagagagattcaggaattaaggattatggtacattgatccctggtcatggaggaattcttgaccgatttgatagtattatttttattgcacctgtcatttattatctgacagttatgatctcaggaggagcgatctagaatgaaatatatttcaattattggatctacaggttccattggaacccaaacactagatatcgtacgaagtaataaagatctgaaagttacagccttagcagcaggaacaagtattgatctgttagagaaacaagcaagagaatttcagccagtgatcgttgctgtatacaatgaacagaaggcagaagagttgaaacttcgtctggcagatacgaatataaaagtatgtgcaggaatggatggattattagaagcagcaacacaggagcagtgttctgttgttgtcacagcaattgtcggaatgatcggaattcgtccaacgatcgctgcgatgaaggctgggaaagacatcgcacttgctaataaagaaacattagtaactgcagggcatatcattatgccaatggcggaagaattgggtgtttctatttatccagtagatagtgagcattctgcaatctttcagtgtttacagagcgggaaaagagatgatcttgattctctgatcattacagcatcagggggaccgttccgcaagaaaacgacagaagaattaaaacatgtgacagtagaagatgcgctgaatcatccaaattggtcaatgggacgaaagattacgattgattccgcaacgttagtgaataaaggactcgaagtgatcgaagccaaatggttgtttggagtggattttgatgatattcatgttgtagtacaaccaaagagtgtgatccattctatgattcagtttaaggatggaagtgtgatcgcacagcttggaacaccggatatgaaattaccgattcaatatgcattattttatccacaacatagaaatcttgcgggagaacgtctggattttgcaaaattaaaagaaattacatttgaagaaccaccagtggatgttctaaaaggacttccttatgcatataaagcaggtaggatcggtggaagcatgccaacagtcttaaatgctgcaaatgaaaaagcagttgcattatttttagaccgtaagattcagtttttagatatttacgacatcattgaagacacaatgaatgcccataaagttattgagaatccgacactggaagaagtgttagagacagagcaatgggtgtatgaacacatagaaagcaggtagatcattgaatattatcattgcaattttgatttttggaattattattattgtgcatgaattagggcattttctgatcgctaagaaaaatgggattcaggtagatgaattttgcattggacttggaccaacgattataggaaagcaggttggagagactttttattctgtcaaactgctgccatttggtggtgcatgtatgatgggagaagatgaagaccgacctgaagaaaatgcgtttaataataagtccgtctgggcaaggatggcagttatttttggaggaccattttttaactttatcttagcatttatattttcaattatagtgatcggaatgtctggtgctgacattccgaagatttccaaagtagaaaaagattcaccagcatatgaagcaggaatccgtaaaggagatactatgatcaaagttgctggaaagaaaatgcacaattacagagagttttcctattatatgtatttagattatgatggagggaaaattccgatcacgatattacaaaacggaaaagaaaaaaatataaacgtcacaccagagtatgataaagaacgagggcaatatctgatcgggatcacctggaatggatatcagaaagtaggtccgttaaaaacgatcgaatacagtttccgagaagtaggattgcaggtaaagattactttaaagagtgtaaagatgttagtttcacaaaaacttggtgtgaaagatctttcaggaccagtaggaattgtcaaaacggtcggagaccaatatacacaggctgccgcctatggatttaaaacagtatttttgacaatggtaaactggatcattttgatcagcgcaaaccttggtgtgatgaatctattgccattaccagcacttgatggaggtcgtttattgtttttgatcatagaagcaattactggaaaggctgtgccacagaatatggaagcgctggtacacactgcagggttgatcttattaatgcttttgatggtatttgtaatgtatcaagatattgtaaagattttcatgtaaagggggatttgcatgtatacaagaaatcagacaagagttatttcgataggagatgttaagattggaggaggcaatccagttgccatccagtctatgacaaatacaaagacagaaaatgtggaagagacggtcaaacagattcttgctcttgagaaggctggatgccagatcattcgctgtactgttccaacaatgaaagctgccgaagcttttacagagattaagaagcagattcatattccgttggtcgcggatattcattttgactataaacttgcaattgcagcgatggaacatggggcagataagatccgtatcaatccggggaatatcggtggagaagagaatatccgcaaagtggtagaaacagcaaagaaatatcatgtaccgatccgtgttggtgtaaacagcggatcattggagaaaccacttgttaaaaaatataacggagtaaccgcacaaggactggtagaaagtgccttagataaagttgctatgcttgaaaaatatgattttcatgatatggtagtcagtattaagtcttctgatgttttgatgtgtgcagaagcataccgcctagtcgcagacaaaatcaattaccctctgcatgtagggatcacagaagctggaacagtttttagtggtaatatcaaatcagctgtaggacttggaattatcttaagtcagggaattggtgatacgatccgtgtatcattgacaggagatccagtcaacgagattgccagtgcgaaactgatcttaaagacattaggacttcgttccggaggaattgaagttgtatcttgcccaacatgtggacgtacgaatatcgatctgattccacttgccaatcaggtagagacaatggctgcagattttgaaaatctgaatcttaaggttgctgttatggggtgcgttgtaaacggaccaggagaggccaaagaagcagatgtgggaatcgctggtggaaatggagagggacttctgatcaagaaaggcgaggttatccgtaaagtaccagaagatcaattacttgatactttaagatatgaattagaacactggggtgaataaaatggaagtgacaacaaaaccatttttcagtgtatttccagatttgaaagtttctgacgatgtaagatctttgtttgaagatgcgaatattagagagatcacactaaagaaaaaagaaaacacgcttaagatttcttttcagtgtgatcatctgatctcaagagtcgatacatggagaatggaacgcacgatccgggaacagctgttttcaaagcgttttgtaaagattcgttttcaggaaagttatcacctgtcagaacaatataatctcaaatatctaatggagcattacatgaaaagcttcctctttgagttaaaaggcaaaggggaggttatttttaatgtcgtgagaaaaggggattatagaattgaagatgatgtgatcaccttttactttgaagatacatttgtaaaccgcaataaagccccagagatcaaagaattttttgagatgattttaaaagaacgtttttctattgatgcaaaagtcggatttgatttctctaagacgattgatcgaagccttaagatggaaagtgattatcgcttacaacaagaaatccatacgatcgtggagcacgcagatatcgttgagaaagaacaaaaagaagagaaaaaagcaagaaagaaagcagctgcaacaaaaaaagagcatatgtttaagaaaaaaccaaaatattcagatgatccaaccttattatatggacgaaattgtgatggcgagctgatggagatcaaggatatctatgatgagatcggggaagttgtgattcatgggcagatcacatttcttgaaacacgagaaatccgtaatgaaaaaacaatcatcatttttcatattaccgattttacagatacgatcagctgcaaggttttcgtaagaaatgaacagttgcccgatattttagatggtttgaaaaaaggtggattctatcgtatcaaagcagttgcgatgtatgacaaatttgatcatgaaatctctctaggatctgtggcaggaatcaaggcgattacagatttcagggaaaaacgtcaggacacatccatggaaaaacgtgtggaattacatctccatacagtgatgagcgataatgacagtgtggtacagatcaaagatattgtaaatcgggcctacgaatggggacatccggcggttgcgattacagatcacggtgtattgcagggatttccgatcgcacgtcatgcatacgaagacttgagactaaaagaagatgatccatttaagatcatttatggggtagaaggatatttcgttgatgaccttggagatttgatcattgattcaaaagggcagtcactaatggacagttatgttgtattcgatattgagacaacaggatttaacagtgtcaatgatcgaattatagaaattggtgcggtaagagtcgtggaaggagagattaaagaaacatttagtgaatttgtcaatccagagcgcccaattccatataagatcactcagctgacaacgatcacagatgatatggtaaaagatgcgggaacgatcgaagagatccttccacagtttttaaaattctgtgagggatctgttttggttgcacataatgcaggatttgatacagggtttatccgcgaaaatgcgaaaagattgaatcttccatatgatcatacagttgtggatacactggggcttgcaagatgtctaatgggacatcttggtaaatttacactggataacatttgtaaacatttaaatatcatactggaaacacaccatagagcagttgatgatgcaacggcaacaggaaagatttttgtagaattcatttctatgttaaaagaaaaagatattacagatctagatcaggtcaacgaatttgcaaatgataatgtcgatctgatcaaaaaaggacgcatgtatcatggaattattctggttaagaataatacagggcgtgttaatttaaaccgcttggtatctgaatcacatttaaattactttaaccgttgcccaagaatgccaaagtccctgatcaataaatatagagatggactgatcattggatctgcgtgtgaagcaggagaattatatcaggcattgcttgatgaacgctcagatgaaacgattgcgaatattgtatcattttatgactatctggagattcagccagtaggaaacaatgaatttatgattggatccgaacgtgttgagaatgtgaattcgatcgaagatattcagaaattcaatcaaaagatcgtagatcttggagaacaattccataagccagtcgttgcgacatgtgatgtgcattttctaaatccagatgatgcaatctatcgttctattttattagctggaaaaggatttaaagatgctgaccagcaggcaccgctttattttaggacaacacaggagatgttagatgagtttgcgtatcttggaagtgagaaagccaaagaagttgtcataacaaacacgaataagatcaatgatatgattgaaaatatttctccgatccatccggataaatgcccgccggtaatcccagattcagacaaaacattaagagaaatctgttataatagagcacatgagatttatggagatgatcttccagaacgagtgacaagtcgtttggaaaaagaattaaactctattattggaaatggatatgcggtaatgtacatcatcgcacagaaattggtatgggattcgaatgaccatgggtatctggtaggatcacgaggatcggtaggatcttcctttgcagcaacgatgtcagggatcacggaagtaaatccgttgccagcacattatatctgtccagaatgtcattttgtggattttgactcagaacaggtgcaaaaatatgcgaagatgggtatgtcaggttttgacatgccagatgcatactgtccaaagtgtggagcaaagatgacgaaagaaggacaggatatcccgtttgagacattccttgggtttaaaggaaataaagagccggatatcgacttaaacttctcaggagaatatcagggaaaagcacatgcttatgtagaagttatctttggaaaaggaaaagcattccgagcgggaacgatcggtacactggcagagaaaacagcctatggttatgtgttgaaatatctggaagaacgaggaatcagtaaacgtcgttgtgaaatagagagattagcacttggatgtacgggagttaagagaacaactggtcagcatccgggtggaatcattgtagtaccgcatgataaagaaatttatgattttacagcggtacaacatccagccaatgatatgaatacaccgatcattacgacacattttgaataccattcgattgaccagaacctattaaaacttgatattctgggacatgacgatccatctatgatccgaagaatggaagatatcacaggaattgatgcacagacgatcccaatggacgataaaggcgttatgggattatttcatggaacagaaaccttagggatcacaccagaagatattgatgggacaccgcttggatcacttggagtaccggaatttgggacagactttgtaattcaaatgcttcaggatacgcatccacagagcttttctgatcttgtccgtatttctgggctgtctcatggaaccgatgtatggcttggaaatgctcagacattgatcgagaatggagatgcggttatttctacagcaatctgttgtcgagatgatatcatggtatatctgatcaatcagggattggaacaggaagcgtcatttaagatcatggaaggagtccgaaaaggaaagggacttacagatgaacaagaacagatgatgagagatcacaatgtgccagattggtatatctggtcttgtaaacagatcaaatatatgttcccgaaagcccatgcggcagcttatgttatgatggcatggaggatcgcatggtataaggtttatcacccattagcatattatgcagcatatttcagtattcgagcgaaggcattttcttatgaagatatgtgtcttggaaaagaacgtttggatgaaaagatgagtattattaagaatacaccaaaacacgaagttaaaaatgcagatcttgatctgttacgagaaatgaagattgcggatgaaatgtatgcaagaggctatgaattctggccactggatatttacaaggcaaaggcaaaagattttcaagtgatcgatggaaagatcatgccagcacttaccagtattgatggaatgggtgaaaaagcggcacagcaggtagaagaagcagccaaaggagaaccatttacatccttggaaaactttagaaacagaacaaaagcaccacaagcatgtatcgagaaaatgaaagaacttggaattatgggagatctatcagatactgatcagttaagtttcgattttctttgataatatatgaaaaaactcttgtcaagagatatttttcatgttaaactaaatatagcttaagaaaagatgacttaggagtgggcatatgtccactcctattttgtgtaacaatgaagaaataacactacaaaagaaagggttgatacattggcaagacgagttgatattgaaacaaaaacagaagaactggtattaccgatcattgaagccaacaattttgaactggtggatgtagaatatgtcaaagaaggagtaaactggtatttaagagtttacgcagacaaagaaggtggaattgcaattgatgactgcgtgctgatcagcagaagcttagaagagaaactggatgcagaagattttatcgaagatgcatatattttagaagtaagttctccgggacttggaagaccactaaagaaagaaaaagattatataagaagtgtcggaaagtccattgacatcaagctttataaagcaattgataagcaaaaggaatttactggtattttaaaagaaaacatggaagatcagatcgtactaacaatcgaagatcaggatattacatttgagaaaaagagcattgcaagtgctcgtttgtcgttagatttttaaggaggaagaaagagaatgagtgaattaattgcggcattaaatcagttggagaaggaaaaaggtattgataaagacgttatcatggaagccattgaaaattccctgcttgctgcatgtaaaagagattttggaagtgcagataacgttgtagttaatatggatcgtgaaacaggagatatttatgtttatgcgatcaaagaagttgtagacgaagtttatgatcctgcattggagatcagtcttggaaaagcaaaggcgatcgatcagaatttaaatcttggagatactgtaagaattgaaatcacaccaaaagatttcggacgtattgcagcaatgcatgcaagaagcgttattgtgcagaagatcaaagaagaagaaagaagagttgtatatgatcacttctactgcaaagaaaaagatatcgtaacaggtgttgttcagcgttatgttggagagaatgtaagtgtaagcttagatgacaaaacagatgctctgttaatgaaatctgaacagatcagaggtgaagtgttcaaaccaacagagagaatcaaactttatattgtagaagtaaaagaaacaaatcgtggaccacgtattcttgtttcaagaacacatccagatcttgtaaaacgtttatttgagaaagaagttgcggaaattcaggatggaacagtagagatcaaaaacattgtgcgtgaagcaggatcaagaacaaagatggctgtatggtccaatgataagaatgtagatccagttggagcatgtgtcggattaaatggtgccagagtaaatgcgatcgtcaatgacttaaaaggcgagaaaatcgatatcattaactggaatgaagatccttgtgtatttattgagaatgcattaagcccatcaaaagttgtttctgtggcagttgatgtagaagaaaagagcgcagaagttgtggttccagattaccagttatcattagcaatcggtaaagaaggacagaatgcgagactggctgcaagattaacaggctataagattgacattaagagtgaatcacaggcagctgaagaagcagcgaaagtcagtgaagaaccagagacagatgaatttgagattgaagaagatctttttaacgaagagatcaatgatgatttcgtagaagatgcagagaatacagaagaagctgttgaagattttgatgcaaaggatattgaagaataggaaatatcagcaggtgataaaatgaatcgaaaaattccaacaagaaaatgtatcgggtgcggtgaattaaaagagaagaatcaattagttcggatcgtaagatcaaaagaaggcgagatcagtcttgatatgactggaaagaaaaatgggagaggggcatatatatgtcctgatccacagtgcctaaaacaagcatttaagaaaaaaggactagatcgttcttttaagataggagtaccggaatcagtctatgagacattaaaaaaggagatggaagaactttatgaataaaggattatctcttctaggtcttgcattcagatccggtaatctggtcagtggagaatttgccgcaagagaagctgtcaggaaaaagacagcagctcttatcattgtagccaatgatgcttccgataatacaaaaaagatgtttgagaatcaatgtaaacattatcaagtacctttttattgctggggattaaaagaagagcttgggcatgcgatcgggaaggagtttcgagcgtcgatcgcagtgactgatcaaggttttgcagaagctcttttaaaacagcttgataaataagaatcgcaggaggtatatttatggcaaaattcagagtttatgaaattgcaaagaaatataataaagacaataaagaaattttagaaatcttgaaagccaatcatgtagaagtgaaaaaccacatgagtaccataggagatgagcagatcaaaatgatcgagaatgcgttgaaaccaaagaaagaagcaaaacaggatcataattcaaagaaacaggaaaattcaaaaagaaaagataataaaaaagcacagaatatggaaaagaaaaataataaaaaaactcaggaagtaaagaacaataaaaataattcaaaaaataaaaataatgatggggataaaaagatcttaagaaaagataatcctcagaactctcagaagtttgggaaaaataataaaaagaataagaaatttaacaataaaaaccagaaccagaatcaggagcataagaaaaagaaaaaaacatcaggacctggtgcctttattaaaccagaaccagtaaagaaaccggaagtagatccaaatgcgccagtaaagattcctccagtattaacattgaaagaacttgcagatgcattatctattcctgcaaatgatatcattaagaaattactgatcagcggagctggaatgttaaatgtaaactctgaacttgattttgaaaaagcagaagagattgcaatggaatttgatcgtctggtagagatggaagaacaggtagatgtgatcgaagaactgttaaaagaagaggaagaagacgaaacagatatgatcgtaagaccaccagttgtctgcgttatgggtcatgttgaccatggtaaaacttctttacttgacaagatccgttcttctcatgttacaacaggagaagcaggtggtatcacacagcatattggagcttatgttgttgaaacatccaatggaaagatcacattcttagatacaccaggacatgaggcattcacatctatgcgtatgagaggtgcccagtctacagatatcgcaatcttagtcgtagccgcagatgacggtgttatgccacagacgatcgaagcgatcaaccatgcgaaagcagcaggaatcgagatcattgttgcgatcaataagattgataaagaaagcgctaacattgagagagtaaaacaggaactgatcgaatatgaattggtaccagaagactggggtggaagcacgatcttttgtccagtatctgcacatacaggagaaggaatcgatgaattattagatatggtttctttaacagcagaagttctggaattaaaagcaaatccaaatcgtaaagcaagaggtattgtcttagaagcacaacttgataaaggtcgtggaccagttgcaactgtattagtacagaaaggtacattacatgttggtgatgcagtagcgatcggaagtgctcatggtaaagttcgtgcaatgataaatgacaaaggaaaacgtattaaaacagcaggaccatctacaccagttgagatcttaggtttaagtgaagttccaaatgctggagaagttatgatggttatggatagcgaaaaagaagcaagatccgtagcagagaaatttattgcttatggacgtgaaaaaatgttatctgagacaaaacagcagttatcattagatgatttatttaaccagatccaggcaggaagcgtcaaagaattgaatatcattgtaaaagccgatgtacagggatctgtagaagcggttaaacagagtcttgtaaaactttctaatgatgaagttgcagtcaaagtcattcatggtggtgtaggtgctatcacagaatctgatgtaaacttagcagcagcttctaatgcgatcattatcggatttaatgttcgtccagaaccagcggctaaagatgcagcaagtgcagagaaagtagaccttcgtctgtatcgtgtcatctacaatgcgattgaagatattgaagcagctatgaagggtatgctagatcctgaatttgtagagaaagttacagggcatgcagaagtacgtcagattttcaaagcctctggagttggaacgatcgcaggatcttatgtattagatggaacaattcagcgtgacagctcagcacgtattattcgtgatggtattgttgttcatgaaggaaaacttgcatctatccaacgtggaaaagatgcggtcaaagaagttcgcagcggatttgaatgtggtcttgttatggaaagctataatgacatcaaagaaggggatcagatcgaatcctttattatggaagaggtcccaagataatttcctgaagggagtagcaatatgagaaaaaacagcattaaaaatacaaggatcaatggtgaagttcagagagaattaagccgtatcatcagcagagagatcaaagatccaagaattgcaccaatgacatctgttgttgatgccgttgtgacatcggatctgaaacagtgcaaagcatatatcagtgttcttggaaatgatgaagaaaaagaagaaacgatgaaaggcttaaacagtgcggtaggttatatccgccgagaacttgcacactctattaatttaagaaatacaccagagattacatttattttagatgattccattgaatatggagtaaatatgtcaaagaagatagatgaattaaatcatgggagtgagaatgaaacactttaatgaacagatttcaaaggctaaaacaattgctattacaggacacatccatccggatggagactgtattggcagttgccttgccttaaaacagtatattttagataattattctgggaagaaagttgatgtttatttagaatcgatcagcgcagagtttcgttttttaagtcatgcgcaggagatcatcacagagtcgaaagatgatgaaagctatgatctgttttttgttttagattgtggctctgaagatcgttatgaaccatttgcagcaatggtcagatgtgcaaaaacattgatcggaatcgatcatcatatcagtaatgatggatttggggacttttataagatcgatccacaggcgagtgcaacttgtgaagttttgtgccagatttttgaagaggataagatttcaaaagaatgtgcccagtgcctatacacaggaatcgtgcatgataccggagtgtttaagcattcaaatacaacacgtaaaacgatggaatatgcgggaatgttactggagaagggtgtttcaactacaaagatcattgatgagacattttatcagaagacatttgtacaaaatcagttgttagggaaagcattattaaaaagtcaactttatgcagatggacagattattatttcgaatctttcagaacaagattttgaagagcttcatgcatcaacatccgacagtgatgggatcattgatcagctgcgaattacaaaaggtgtggaagcagcaatttttctatatccgatcgaaaatggctataaagtaagtatgcgttcgaatgagaaagttaaggtttcagagattgctaaaacacatggaggtggaggacatatccgtgcagcaggatgttccatgaaaggaacattgaaagacattcaaagtacgatcataagcgagatcacagaacaattataaggtagaggtttttatgtacaacggattattgaatatatataaagaaaaagattttacatcgcatgatgttgtcgcaaaacttcgagggatcttacgtcagaaaaagattggtcatacaggaactttggatccaaatgcagaaggagtattgccggtctgtcttggaaaaggaacaaagttatgcgatatgttaacaggaacgaagaaacagtataaggtaagctttgtgtttgaaaaagagacagatacagaagatatatggggaactgttacgaaaacacatgaaccgttaaagcaagatgcaccgatcaaagatacgatcttgtctttcgttggagaatatgatcaggtaccacctatgtattctgcaaagaaaattaatggaaagaagctgtatgaacttgccagagaaggaaaaattatcgagcgcaaaccagaacggatcaggatctatgatatttcagatattgaaatctcttatccagaagttacaatgacagttacatgcagcaaaggtacatatatccgaagtctttgcagggatattggacataagcttcaaaatggagcgtgtatgacaaagttagtccgtacaagatccagtggttttcaattagaatatgctcatacattatcagagattgaggaagcagtgaaaactggaaaaatcgaagaatggataattccaattgaaaaggtttttctaaaatatcaaaaaggtaccgtaaagaaagactatgataaggttttatttaacggaaatcctttaaagaaagagatgttttatgaaatagatctcgatacaacaaagaaacttcgggtatatgatgaaagtgaacagtttatcggaatatattactggaaaaaaaatatgtttttcccagataagattttttatgacaacaaccaatgagaggaagccatggaatacattcataatacagaacaatttcaatttcataatacagtggtagctcttggcaaatttgacggaatgcataaagggcatcagttgatctttgatgaactgattcagtataagcaactgggatatcaggcggctgtattttcttttgaccgtccaccacttaatatgttaaaacacaaacatatgagagtgatctacacgaccaacgaaaagataaaacttcttgcaagaagaggaattgatatttatatcgaacatccatttacagatgaattctcacatttatcaccagaagattttgtgatcaaagtacttcttgaaaaaacaggaatgaaagttttagttgttggtgatgattgtgggtttggttataaacgtcaaggaaacgtagaattacttgaacggatgtcaaaggaatatgattttaaattgatcgttattcccaaacttgaattagaaggagaaattgtatcaagcacaagaatccgtcatttgctatctgagggtaaagtggaggaagctaatcgtctgatggaagatccgtttatgatctgtggatctgtagttcatggaaatcatatgggagcagaagtacttcaaatgccaacagcgaatcagattccattggaggataagttattgcctccaaatggagtatatgtttcaagaatccattataaagatgaaacgtattacggaattagtaatgttggagtaaagccaacgatcgaaggaaagaaacatatgggagttgaaacatatattttagatttccataagaatatctatcataaagaaatagaagtggaattattgtgttttaaaagaccagaaatgaaatttgattctctagaatctttaagccagcagatgcatgaggatgcggaatttgcaagaagatatgcaaaagaacattatggatatgaagcataattgaacataaaaatgtacaatttttcttttaaaaatcatttatttgtagtataatattcataacaaagaataacttgaatattttatcctttggggaaaggagcgattcatatgagtactaacacaattattacaatcgaacgacaatatggaagcggaggacacttgattggagagaagcttgccgaaagtttaggaatccctttttatgacagtgaactgattaaagttgctgcaaaggaaagcggcatttgtgaagagatctttgaaagttttgatgaaaaaccaacgactagttttctttactctctggtaatggatccttattcattaggatacaattccaattcttttgacttgccattgaatcataaggtgtttttggcagcttttgatacgattaaggaactggcatcaaagggaccttgtgtgttcgttggaagatgtgcagattatgcgttagaagactttgataattgcatcagtgtatatgtacatgcaccatttgaggatcgtatcaaacgaattgagaatgaatatggaattccgaatggaaagagcaaagagatgctgatgaagaaagataaacaacgttccagctattacaactattacagttctaataagtggggggatgcaaaatcatatgatctttgcttaaacagcagttatttaggaattgatggaagtgttgatctgatcaagaaagtaattgcaatgaaagaatcagagaagtaatcaacaatataagatgattttaaaggccgtattatttttaatatggtctttttttgagggcattttgaatctttttatcgtattttaagctgcaaattataagagagtatattgttttgtcgaaagatgtgttagaatagaaaacgttataaaaactatgtaaaggagagagacatatgaaaaaatttttagaagaatttaaggcgtttgcactccgtggaaatgtcatggatatggcggtcggtgtattgatcggtggtgctttttcagggatcgttacatcgctcacagataattttattcagccgatcataaaattggttatgacaggaaaagtatacacattagaagaaatttcaggatatgcatctgcatttggatcttcggttgtgaattttctgatcatggcgtttatcttattttgtcttttaaaagcaatgaataaggtcatgtcatttggttcaaaaccagaggaacctgcacagccaactacaaaaatctgtccattttgtatgagggagatcgatattcgtgcaacgagatgtcctcattgtacatctgtgcagccagagagcgaagcagatcagaaatagaaaagagtataaaatgaaagtaacaattatacatggacagagtcataaaggctctacatatcatatttccaaaattctggcagacaagattggcggggaagtcaaggagttttttctgccaagagattttggggaattctgtattggatgtacacaatgttttcgtaaatccgagacattatgtccacattatgaaaagatcaatccattaacagaagcacttgatgaagcagatgtattgatttttgaaagtccagtgtatgtttatcatgtgactggctctatgaaagcgtttttagatcattatggttatcgatggatgttgcatagaccagaagaatcaatgtttcacaaacaggcggtatgtatatcaacagctgctggtgcaggaatgaagagtacaaataaagatatggcagacagctttttttactggggagtgccaaaggtatataaatacggtgttcgtgttatggcaacttcgtataaagacataaaaccaaaaataaaagcaaaaattgaaaaagatacaaataaaatggcatatcagattaagaagaatgctggacatgtgaaaacaggaataaagacaaagatttgcttttattttatgagaatgcttcataccagaggctgggatgaggccgaccttgcctattggagtaaaaaaggctgggatcgagaaaaaagaccttggaagaacaacaaaggagtgtgacattaaatgaaattaaaaaaattaacaatatctgccatgttggtggcagttgcagtcgtattatcatcattttcaatcccgatcggaccgagcagatgctttcctatccaacatttatgcaacgtgctggctgcagtgtttctaggccctgtatatggagtttctatggcattttgcacagcactgatcagaaatctactcggaacaggaagcctgcttgcgttccctggaagtatggttggggcatttgtcagtgctatgatttttaaatatacaagatctaagattggtgcatatcttggagaagtgattggaacagggattttaggtggaatgctttgctatccgatcgcatccatgatgatgggacagaaagcagctttatttacatttgtagggccattccttgcaagtacgctttgtgggactgtgatcgcagctgtgatcattacagcattgtataaatcaaaagcggtccgtttgatcgaaaatatatagactaaacatttaaaggagcgttcgaaggagttacgggcataaggaattaagatacaggagatatttcatggaaagagacttaacgactggaagtattggaaggaatattttgaaattttcacttccgtattttttgtcatattttttgcagactttatatggaatagcggatttgtttattattggacaatttaatggagttgctagcacaaccgctgtttctatcggaagtcaggtaatgcatatgatcacggttatgatcgttggaattgcgatggggactaccgttatgatcggtaaatccgtaggtgcaaaacaaaagaaagaaacttcaaagatcattggaaatactgtcagtttgtttgtatgtctttctgttgtacttacagtggtgttattattttttgttcatccaattgttcgtatcatgtcaacaccgcaacaggcagtagaaggaacaaccgcatatttaaccatatgttttgcgggaattcctttgatcactgcatataatatcatcagttccattttcaggggattgggagattcaaaaagtccaatgtattttatagcagttgcttgtggagtgaatatcgttctggattatgtttttattggaggacttcattttggagcttcaggtgcagcacttggaactacgttagcacagacgatcagtgtgatcgttgcacttattgcaattcggaagaaagatactggtatttcattaaaacgcagtgatttaaaaccagaaggaaaaacattgaagaatattttagggattggaattccaatttccttgcaagatgggtttatacagatttcctttattgtaattacgatcattgtaaatcaaaggggattaaatgatgctgcagctgtaggaatcgttgaaaagatcatcagttttgtatttttagtgccatcttctatgctgtcagcagtttctgcgattgcagcacaaaatattggcgctggaaaagatgaacgtgcaacaaagacattaaaatatgcgattatgatttctatgagttttggattatgtgttgcagtgctgatgcagtttatttcaaattttgttgtgggaatctttacagtcgataccatggttattcacatgggaagccagtatattcgaagttacatatgggattgcatgatcgctggaattcattttagttttagcgggtatttttgcgcatatggaaagtcgggaatttcttttcttcataatgtattatcgattgtactgattcgtattccaggggcttattttgcttctaaatggtttatagacactttatatcctatgggatgtgcagcgccagcaggatcattattatcagttattgtgtgcgggatcgcatttatatatttaaaaagaaggagaagactatgagtatattgattaaagatacaacaaaagaagaacgagcaaaaatcgtagaggaatctattggaaatattgcaggtgcatgtgatgggtgcagtgtaggtattgtggaaatgtatcaagactatattgatggaaagaaagaactaagagaaatcaatatggagtttcgtgcaggatacatttctgaaataagaagataataaggagaatatagatggaaagtagaatagcgatcataggaattatcgtagaagacatagatgcatcttcaaaggtaaatgatattttacatgattatggaatgtatattctgggaagaatggggataccataccacgagaagggggttaacattatcagcatcgcaattgatgcaccgcaggatattattaatacgttagctggaaaacttggaaaagtagaaggaatcagtgcaaaaacaacatattcaaagatgtaaaaaatagaaaaaaagttgttgacatactgtatacatctatggtaagataatcaacgtcgctgaaagagcggcaggaaaatataacatcggagctgatctggcttctgaaaagaataaaaaaacttcttgacacaagtgatcagatgtgataatctataaaagttgctgacggagaacgatcagaacaatagagatcagatctgaaagaaaagttaaaaagttcttgacagatgagatcagaaatgatattatataaaagttgttgcagagcagaagagctcagaataacaaaataaattaaaaaagttcttgacaaacaaaaagaactgtgataaaataataaagtttcttacacacaagaagcggatcacaaaaagatctttgacaactgaacaataagacaaccttgaaaattctaatgaatttttcagatgattttagtaaaaatcaacgaacgttctttatagagaacagtaatcaacaaggataaagaagctagtgcttcttgaacttggatcaacattgaacatgagagtttgatcctggctcaggatgaacgctggcggcgtgcttaacacatgcaagtcgaacgaagctgcttaactgatcttcttcggaattgacgttttgtagactgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaagaagaagtaaaggttgttttattgttgagctgtcaaaggcttaaaactgaatattccggtggcgatgcgcgtcggggtcacacccgttcccatcccgaacacgatggttaagactgacgcggccgacaatacttggctggagacggcccgggaagataggtggctgccggatctataaaagagttttgctcttatcgatgattcgatctaagaataaacattcttggatggcatggtcgataagaccagaagtgtcgaagatacaggatattgtttctgaaacacggatgtaccttgaaaacttcatacaagaattaagatagaattcattttcagaaatggaaatgagtcaagacatcaaagaaattcaaatttcatcgttaataacgagataggaaaatgaaaaaaacacaaagcccgctgatgtaacgctatacatcagtgaggaaacagagaatcaagagattcgatcgttcctgctacggttaaagtagtaagggcgcagggtggatgccttggcactaagagccgatgaaagacgtgataagctgcgaaaagcttcggggaggagcacatatccaatgatccggagatatctgaatggggaaacccggcagaggaaacctctgtcagcgtgcagtgaatacatagctgtacgtggggaacctggggaactgaaacatctaagtacccggaggaagagaaagaaaatttatcgatttccaaagtagcggcgagcgaaatggaaagagcccaaaccgtgatgcgtgcatcgcggggttcggactgcgttgtggcagacgtaagataggagaacggactgggaagtccggccggagagagtgaaagcctcgtatccgaaatcccaagtcgcttagcaggatccagagtaggacgagacacgagaaaccttgtctgaacgagcggggaccaccccgtaaggctaaatacttcttagtgaccgatagcgcatagtactgtgaaggaaaggtgaaaagtaccccgggaggggagtgaaagagaacctgaaaccctgtgtctacaagctgtgggacctctttatatgagggactgcgtactttttgtagaacggtccggcgagttgtgcgtactggcgaggttaaggacttaaggtccggagccgaagtgaaagcaagcgttaatagcgcgatgagtcagtgagtgcagacccgaaaccgggtgacctatccatgtccaggttgaagcttccgtaagaggaagtggaggaccgaacccacatccgttgaaaagggtggggatgaggtgtggatagcggagaaattccaatcgaacccggagatagctggttctcctcgaaatagctttagggctagcctcatgagagtcttatggaggtagagcactgaattgcctagggggcgtcaaagcttaccaaagcatatcaaactccgaatgccatcaagatgattcatgggagtcagaccatacgagataagttggatggtcaaaagggaaagagcccagacctacagctaaggtcccaaagtacgtgttaagtggaaaaggatgtggggattctaagacaactaggacgttggcttagaagcagccattcattgaaagagtgcgtaatagctcactagtcgagagtccctgcgccgaaaatgtccggggctgaaacacgacaccgaagcttaggaatgtgtaaacattggtagaggagcattgctggcgggatgaagccataccgtaaggagtggtggactgccaggaagagagaatgccggaatgagtagcgagatgaaggtgagaatccttcaggccgaatatctaaggtttccagagtaaagctgatctgctctgggtaagtcgggacctaaggcgaggtcgaaagacgtagtcgatggataacaggttgaaattcctgtaccgcatataaacagaactgtggggacacagacagggaatggaatccgggagtggagatcccggtgcaagcgaggtaggagtgctgttggcaaatccgcagcacgatctgaagacgtgacgcgtaccgaacataagtagggaagtccaggcccctggctgtcaagaaaagccgctattgttttatatgtgcccgtaccgcaaaccgacacaggtggatgaggagagaatcctaaggccgacgggagaagtattgttaaggaactcggcaaaatgactccgtaacttcgggagaaggagtgccatgagagtggccgcagagaaatggcccaagcaactgtttagcaaaaacacaggtctatgcaaaaccgcaaggtgaagtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacgatacacccggtgaaattgaaataccagtgaagatgctggttacctgcgccaggacggaaagaccccatggagctttactccagtttgatactgggattcggcatggtatgtacaggataggtgggagactgagaaggtatgacgtcagttgtaccggagtcgctgttgggataccacccttaccatgttggatttctaacctgtggccgtaagccggtcaggggacaatgtcaggcggggagtttgactggggcggtcgcctccgaaagggtatcggaggcgctcaaaggttccctcagaatggttggaaaccattcgaagagtgcaaaggcagaagggagcttgactgtgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggagctgtagcaggttccaagggttgggctgttcgcccattaaagcggtacgcgagctgggttcagaacgtcgtgagacagttcggtccctatccggcgcaggcggaggaaatttgataggagctgtccttagtacgagaggaccgggatggacggaccgctgatgtatctgttgtactgccaagtgcatagcagagtagccaagtctggaagggataaacgctgaaggcatctaagcgtgaagcccccctaaagataagatttcccataccgaaaggtagtaagaccccttgaagacgacgaggtagatagggcagaggtggaagtacggtaacgtatggagctgactgttactaatcggtcgaggctttaaccaaagaaggctgaagtgtaagagatgtagaaagattcttgtatgttgttttgaaggtatatcctttatatatagatttaatatgaagatttaagcattcttagagataaggatgttttttttcgtttcattagaatgttccggcacagagaaaaaatccttctatgcggtattctttctttgtggtataatatatattatcagatagatgaaaagaaggggtaaaaagatgaaaaaattcataaaatatggaagtatcgtggttatttcattagttatattaataagttgtaacgtaaattcgtatgattgtgatgtatttgcagaagaaaagaatgaagaacaaaatacagaaactgatataatatgcaattggccagaagatatcatagatccaggaccagcattaccccaatatctttctgctccaaaaatcatgaatatattgaatacgaacaaaggaattaaagttcaatggaagaaagtaaataatgcgcatggatatcgtattcagagaaaattaggaaatagtaagtggaaagatctgaaaatactaaaagaaaatcaatatacggataaaacagtagagaatggtaagaaatatcaatataagatttatgcatatgcttctaattccattgattttatagagtcaactggaacaaaaagtattacaaaaaagattttatatttgaaggctccagtgatcagtaatataaagaaatctcaaaatacaagatacaaaattgtatggaagaaaaataaaaaagccgatggttataagattcaaatctctacatctaagaaatttaagaataacaagtctaagataaaagaaatttcaacttataagttcaatcctaagatttatggaatgaaaaagaaaaaatcgtattatgtaagaattcgtgcttataaagtagatggaaagcaattacattatagtgcatggagtaatataaagatattaaaatagcaaaaatgaagtattatgaacgttatttattcataatacttcattttttaaatagtatttgggcttatatcagaatattaataagcaatcagttcataaccatcttctgttacaagaacctgaacttcccactgtgcagaaggctgtccatcatcagtataaatctgccattcgtcaacttcatcaacataaaactcgtcggtacccatattaaccattggttcgatcgtaaacatcataccaggagccataaccataccagtaccaggttcagaaacatagcttacataaggatcttcatggaactgaagaccaacaccatgcccaccgatttctttgacaacagtgtagccattttctacagcatgcatatgcactgcatgtcccatatcgccgagaagtccccaaggttttacattcttaagaccaatctcaacacattcttttgtaacatcaactaattttttcttttctttagaaacttcaccaatacagaacatacgagaagaatctgaaaaatatccatgatagatcgtagaaacatcgacgttgatgatatcaccttcctgtaaaacgacatcttctgaaggaattccgtggcatacttgatcattcactgaagtacaaacgctcttaggaaatccctcataatttaatggagcagggattgcaccacgggatgttgtctgttcatatacccagtcatcaatctgctgtgttgtaactccagctttaatatgctctgcaacataatccaaaacagcgatattgatttttccgctttctttgatcttctcaatctgttctggagttttgatcatatcgtgagatgggatgatatgtccttcttgctgtaattcttttaatttctcatcaaactgacagtggcattttttgtatttttttccactgccacaccagcatgcatcatttcttccgatagtttccattttttgcacttcctttattttcattcatttttaatacgattcctatggaatcaaactataccaattttactataattaagaaaaaatagcaatgaagtgcgaatgattttattcctcatttatgaaaaagctatcaaggaaaatttttgattcgtattccagacatattttctttcgtgtataataaaagagacaaaggggagttgtcaatcaagtaagaaacaaggagaatgcgtatggaaaaaagaagaaaaaggatgatcaaacaatgtctgtcatttgctctttcgctagtgatggcattgacaattgtgacaccagtaaaagcagcacaacaacaatatgtaccgacacaggaagatattgagattacaaaaaatatcaaagatattcagacagccgggtactattctgcagcattgatgaagaacggagatttgtggacttggggatctatggcggcaatggacaaatatcatgcgattgattcaagtctgtatacaccaaaaactccatcagtatttatgacaaatgtaaaagaatttgtacttacagatacttattatgcggcgattaaaaatgatggaacattatggatgtggggatgtgacacgaacggtgaattaggaatcggtgattgtgaacttaataattttttcccaagacaagtaaacataccaaaacgggtgaaaaaagtaattctatcgaataaaggctggaataaaacagtagccattacagaggatggagatctttacatgtggggtgataatagtgcctatgggcttggaatcggtgaaaattctgataactcgaaaagctataatacaccacagaaggtaaatggaatttcagatgtttccgatgtaagtatatgcggatcgacaacaacagcaataacatcttctggaaaagtttatgcgtggggaaatatttacgaatatatggatcagatgacacattatacaccagaagaagtcaagaatatagaacatatttcagggcagatcacaaaaattcaatttagtcaggcaggatatacagcattaactgaaaatggagatttatatgcatggtattattctgatatggatgaaaattatgcaggaagaaatgattcagaagacaaaacgataccaaaaatgattttatcaaatataaaatcatatgaaagcggaacaacttcatttgcagttacaaaatctggagaagtatatagttggggacttaatagcaaaggtgaagctggtcttggaacttatggaaatagttcttgggaagattcctatgtattaacaccaaccaaaatgaacattagcaatgtaaatgaaattgtaaaaacagaaaattttaaaggaatttcaggagcgtatgcagcaatcacaaatgataaaaagctatatatgtggggatcaaatttctatggaatctttggaaatggcaagaaaccgaacaccggggcgtatgattcaaagaatttttatatggttgaagccaatccagtacagattgcagatcaggtaaagaatgcaagctattactcctatgaaagtagtttttatctgaaaacagatggatcactttgggcaagtggaaatgcaagatacggtgtactaggggaacaaagagatgaagatgttacacaaaatgaattttacagaaatccgattctcatcacgctaaaaggaaaatccccatcgctaacagtaaaagatgacaataactcaggaatcactgattcaggagaaccagattctggggatatcgacgatggagatcatggaagtaaccagaaacctgatcagggaaacaaagacaacgcaggagacaaacagcaagatcaggtcggtggacagatcaaaccatccactccagcaacaaagaaaccttctaccacaacagcaatcacagtttctggaacaaacatcttgaaagttcagaatatcaaaggaaagaaagcaaagattaggtggaagaaaaacaccaaggcagcaggttaccagattcagtattctatgaagaagaacttcaaatccggagtgaaaacagttaatatcaaaaaaaataaaacagtatcagcaacgatcaaaaagctgaaaaagaaaaagacttactatgtaagaatcagatgtatgaaaaaggctggaaagaaaacaatttattctaaatggagttcagtgaaaaaagtaaaaattaaaaaataagcagattaagaaagcagaaatattttatgaatcagagctataaatacttagattcttgaatatttctgctttttatttaatgtttctgaccattcacattatgcgaagcagattccctcaatacaactttccctgctgcctgacgccgtctcgtatcagacattgccgcataatgttttcgagtcgtattaacatcagagtgtccaagaacctccgccacaagataaatatcatcggtctcctgataaagagcagtaccataagtactacgcagtttatgaggagtgatcttctttagtggagtgacttccttcgcatattttttcacaagattctggaccgcctgcacaccaattcttcgtctttgcatagaataaaataaagcatcttcatgcccttcctttggaatgatgagttttctgctgccttccatatactgctccaaagcatccgcaacttcatttccaaaatagacggtcatttcttttcgtccttttcggatcagatgaagaccgttattgcggaaatcaacatcatcaacgtttaagcctactaattcagacacacggattccagttccaagaagaagtgtaatgatcgcaagatcacgttccttggtcttttcataataagcaagtttctgtccagtcaaatggtcaccaccgtgttctacaaaatcaagcaaagaagcaacttcatcggcttctaaacggataatttccttctcacggatctttggcatatcaacaagcaatgttggatttttctcaatcaactgtcgtttgtaaaaatatccgtaaaaagaacggagtgcagacatcttacgaaaaacaccttgttcagtattctgcatatgcttatgttgttcttccgaaatgtaaacctttaaatattccatatattcttccaaatcaacggattcaatcttatcaagatcacttactttaaaatccagcacagagtaattacggtaagcaggattttcatcgatcagaaaatgaaagaacactctcagatcatatgcataagcaattcgagttcttacttgtgtggtagaatcaattgcacggaagaattctttcgcaaaaggcgggagtgttttaataagttcacgtaatttgatcgtctgtcttgcagtcagatcgtcataatatggtaatgatttcataaaattcacctgtttcttatttatttagcataccatttacggctattcagtagtagtaaatgaaaataatacatgacttattctatcaatttttcacaaagcttgcaaactttccccttctatgtataataatagttagccaagactaactaaaacaaaaataaaaagaaaggaacatttcgtgtatgatgcaattttttaaatcatcaacaaaagaagcgatgaacttcctaagatatgtcggaccaggtttactagtcaccgtaggttttatagatcccggtaactgggcaagtaatatcgctgcaggttccggatatggatatacattgttatggatggtcacattatcaacgatcatgctcattatcttacagcataatgcagcacatctaggaattgtcacaggaaaatgtttatcagaagcaacaagtctgtatattaataaagggtttaagaacatcattttattaacagcagttgcagcatcgatcgcaaccgcaatggcagaacttttaggtggtgcaatggcattagaaatgctgtttcatattccagtaaagattggtacatttatcattttagggatcgtactgatctgtcagtttacgaatgcatacagcagaatcgagaaactgatcatcttatttgtatcactgatcggattctcttttctgtttgaaatctgtattgcagatattgaatggaaacaggcgctgatcggatgggtaaagccagaaattcccaaaggttcacttccagttgtcatgagtgttctaggagcagtcgtgatgccacataacctgtttttacattcagagatcattcagagcagagaatggaatctaaaagatgaaaatgtgatagaacagcagttaaaatacgagtttaaggataccttattttccatgatcataggatgggcaattaacagtgcaatgatcttaatggcagcagctatcctgtatcaaggaaatggtcattctattgatgatattcatttagcaggttccatgttaacaccacttcttggaaatgcagcatcaattatttttgcacttgcattattacttgctggaatttcatcaagtattacagcaggaatggccggtggaacgattttttctggaatttttgatcatccttatgatattcatcataaagatacgaaattaggagttcttattacgatgattccagcaacattgattattttactgataaaatctccattcgatggattgatctattcccagatgtttttggcagttcaacttcctattacgatctttactcagatctatctgacatcctcaaagaaagtcatggggaaatatgcgaattcgaaacgattaaagatcatactttttatgattgcactgatcgtaacatttcttaacatatgtctgtttgtgactggattttaaatataaaaaatgagataataaagataaaaaaagaaaggagcatcttatggaaattaaatatttatcaattaagaattttaaatcaatccggcatatggaaatatcagatatccagaatgctctgattcttgttggaaagaataatacaggaaaatcatccatccttcatgccttgcgtgcagtcgaaggatcttatgaaatctcattggatgattttaacgagacaatgcaaaatatagagattggatttatattatccattacagaagaagatcttcatatttttcataaaaatggtatagtgagccagtataaaaaatacgatctttggaaaaaggattttgagagcaaacttccatcttacaaaaatgaagagatcacctttacattcattgccaataaagaaggcaaacagcggttttacgatggaaaaaggaaacataataagtatattcgggaaattttcccaactatttatttcattggaacgaaccgtaatttaaaacagatacaggatgatctttttatgctacaggaagacagtttgcttaagatcatgcgtacaaactgctgtatgtttgatcctgtgaaaccatgtacccattgttttcagtgtatcggtctgatcgatcagaagaatccaaaagaactgaatgcatttgaggctgcaaagctatttgaatataaattgtatgagatgaacattgaccagtttgagaaacgtattaatgagagcttccataagaacggtggatttgaggatattattttctctatgaattatgatgttgaccagatgcttcaagttaatgcagaagcttataacaaagaacgtgatatttcaatttctgtggaacgattggggcgtggaatgaaaagtatttatatgctttctcttctggaagcttatgtaatggatgagaatagtctttcatcgatcattctggtagaggaaccagagatgtttttgcatccacaactgcaaaagacagccagtgagatcctttatcgtctggcacagaagaatcaggtgatcttcacaacacattctccacacttattagccaattttagcagtagacaattatgtcagatcatattggatgaagattcatattctgttgcaaagaagaaaacgaacattagttcgatattagacgatcttggatataatgcttccgatcttatgaatgtcgattttgtttttatcgtagaaggaaaacaagataaataccgtttgccattgttgttaaatcattattattctgaaatttatgatgaagacggcagattaaatcgtgtagcgatcctgacaacaaacagctgtaccaatatcaagacgtatgccaacttaaaatatataaatcagctttatatgaaggatcgttttttaatgatccgtgatagtgatggtaaggatcgagatatgcttggaagacagctttgtaaatattatgatgagagaaatcttgtggatgttgatcatttaccaaaagtgacaagaaaaaatgtattgatcttaaaatattattcttttgaaaattattttttaaatccagagatcatgtcaaaacttggagttatagaatctgaagatgctttttatgagattttatatgataaatggagagaatatctgcataggatcaaaagtggagttcatttgatacagatgatgggacgtgattttacatcaccgcaagatatgaaagaacatatggaagagatcaaaacctatatgcggggtcataatctgtttgacattttttatggaagatataaaaaagaagagaaagatttattaaagaaatatattgagatcgcaccaagagatgaatttagtgatattcttgatgcggcggattcgtttatctattttcagagtaagacaaaacaaaaagatattcagaatgaaacaaaataaagaaagtgcgagataaataatatgacaaagaaacacacaatattaacagcgatcaattcgaaatacattcattcgaaccttgcagtttactgccttcgtgcctacgcaaagccatatatcgatgaagtcgagattgcagaatatacgatcaatcagcaggtggatgatatcctgatgagtctgtatcagaaacatccagatatcctttgcttttcctgttatatctggaatattgaatacatagaacgtgtgatcagggaaatccataaactactgccggatgttccaatctggcttggaggaccagaagtttcctatgattccagagaagttttaagacgacttccacaggtaacgggtgtgatgaaaggggaaggagaagttacattccttgaagtgcttgatcattatcatggaaagagagatgatcttagcaagattcctggactaacttatagaaatgaagatgagatcgtagaaacaccatggcgtccagtgatggacttaagtaaagttccatttgtgtatgaacatattgaagattttgaacataagatcatctactatgaatcaagcaggggctgtccattttcatgtagttattgtttgtcttcgatcgataaatgcctgcgtttccgaaatctttctcttgtcaaaaaggaattacagtttttcttagatcataaagtgccacaggtcaaatttgtcgatcgtacctttaactgtcgacatgatcatgcaatggaaatctggcgttatataaaggaacatgataacggcattaccaatttccattttgaagtggcagcagatgtcttaaaggatgatgaaattgaattgatctctgatatgcgtccgggactgattcagttagagattggtgttcagtcaacgaacatcgatacgatcactgagattcacaggaaaatggattttaagaaagttgtagatatcgtaacaaggatcaatgctggacataatatacatcaacatttggatctgatcgcaggactgccctatgaagatcttgaaagttttaaacagtcatttcaggatgtctatgaagtacgtccagaacaattacagttaggctttttaaaagtattaaaaggttcttatatggaaaaacaaaaagagaactatgggcttgtttataaagatacaccgccttatgaagtcctttatacaaaatggctgccttatgaagatgtactggttttaaagaaagtggaagaaatggtggaagtttattataatagcagccagttttcgaacaccttgcggttgttggaaaaagaatttgacactgcatttgctttatatgatacacttgccagattttatgaggagaaaggttatgacaaggttagccacagccggattgcccgatttgaaatcttatatgaatttatacaaaccattacagcagaagagaatcttgtattatataaagagttgttaacgtatgacttatatcttcgtgaaaatgtaaagaaacgtccggattttgcaggagattatacattacaaaaggacgagcttcgttatatcaacgaagagattttattaaaagatgaacgacttgcatattttggacaaaagaatatgcggaaattttcccatatggaacaattcgatcatgcggtaaatgaagattttaaagaaacaaaaaccatcctattgtttgattatcagaatcgagatccattgacaaaccaggcgacagtttatccgattacaatgaatttgataaaaaatcaataaaaatatagtaagaaagagggtgcagaaaataagatgatcgcaatatatttagcaccactttatctgctgttaaatgtctattttttattccgaatattgaaatggttagagacttgtcatgtttattttaaaaagaaatggatcaaagcagttttggtcatgatctatgtatttcttgcattcagtattctgatcgcatttttgtttccacaaggaacgatacggcgagctatgaaactgatcagtaattactggctgggtgttttgatgtatttggcgcttacgatccttattgcggatctgatccgcctaatcttaatctattttgtgaaagcagatcagaaaaagtttcggacaccaaaagtttttaggattgttggaagcatttgtatgatcttgatcttattgatcagtttttacggagtgtgtaatgcaaggaatatcaggacaacaagttaccatgtaacgatacataaaaaagcaggaaatcataaaaagctaaagatcattttacttgcagatcttcatcttggatacaatattggatgttctcagatgaaacagatggtaatgaaagtaaatcagcaaagtccagatctgatcgtggtcgcaggagacatttttgataatgaatatgatgcattagatgatccagatcagttggttaagatatttcgacagctaaagtgtcaatacggtgtttatgcagtttatggaaatcatgatattgatgaaaagattcttgcaggatttacatttggaagcggtcgggagaaaaaggtcagcgatccaagaatggatgaatttgtaaaaagggcaggaatgaagttattaagagatgaatctgtctgtattgatcaaagcttctatctctatggaagaccagatgctgagaaagtaggccgtgggatcagcagacgtaagactccaaaagaactggtaaatggaatggatcttaaaaagcctgtgatcgtactggatcatgagccaaggcagttggaagagttaaatcaggcaggagtagacattgatctttgcgggcatacgcatgatggacagctgttccctgggaatattacaattcatttgttttggaagaatccgtatggatatcgtaaggttggaaatgcgcatcagatcgtaacttcaggtgtcggtttatttggcccgaatatgagggtcggaacgaaagcggagattgtggttgtgaatgtggattttagatgatctgacaaagatgtcagttatactataataaacaaatggaggaagacatttttatgaaatatcacgatggaaaagacagatgcagttgggctaatccaaagaatccgatatatattgagtatcacgataaagaatggggagtgcctgtctatgacgaccataaattgtttgaaatgctgatcttggaatcgtttcaggcaggattatcgtgggagtgtgtgttaaataaacgagaagcgttcagagaagcgtttgatgattttgatgtatataaagtgagtgcatatgatgaggagaaacaagcgcaattaaaagaaaataaaggaattataagaaaccaaagaaaaatatctgctgccgtatcaaatgcgactatttttatgaaaatccaggaacaatacggaaccttttctgaatatttatggaagtttacagatcataagattattcatgagatgggaaaaacatcctcagaattatccgaccagatttcaaaggatttaaagaaacgtggaatgaaatttgtcggtacaacgattatttattcctatctgcaggcagtgggagtggtcgagtcacatgaggaaggttgtttcctgcatcataaagaataaaaaatttacaagtacgtaacactgcgtacttgaatttttatacaaaaaggagtaaggtagaaatcaccagataaaattgagtattagaaagatgatcatgtcataacaatgttcaaacaaagggaggaagcgatcatgagacgtaagattatgacagcatttgtatgcgcgattatgacaatctctgtaataccggtttatgcagatgatacacagaccgatcaggcagtgacaacagaagtttctaccgaaacagcagcaacggtgcaagaaacaaaaagaacgcaaagtaaagaacaacagaagaaaaagacaacaagcaagaaacatactaagacaaagaagataaaatcaaagaaaaaggaagaaaacaaagtcattccaatgccaacacaagtgatcagtaagagttcttcggatacgatcgaaggaaggatcaaagataaacaggcgaaagtgaaacagttgaaaaaacaaaaagcaaagattgaggaggagattcgcctggaacagcaaaaagcacgatctataaatgaattttacaaaaagtatacagcaaattccaaggctgagattgctttatatgggcaggagatcactccttctatgaagatttctaaaaaagatgagcagttaagagaagatttatatgagcttgcagatttatttggagatgagaatctgagaacgatcgcaagcaaatatgtctttggaattaatcatccggattttgagactttgcttgatatgaatgaaacgattcagcttgatcagtatttaaagaacgaacagatacttccgatcaaaccaatggaagaaaaggttcagacgatcaagaagcagatcaagaagttcaaaggagagatcaaaaaagaggaacagacaagatattttaatccaaatgatgtcagtgctctaagtcatatcacagtttcagacgccaaacatattttggaaggaactgctttgtatgatgatgcgaaagcttatgtcaaggcggaagaaaaatatcatgtgaatgcagtctttttgatgggaatcgctgcacatgaaagtgcatggggcacgagccgccgtgcgagggaagataataatctgactggatatggtgtaacatcggatcatgcaaaaggaattaacaaatcaacgaaagaagcaggacttttagcaactgcagaaactttacatgaaaaatacctgacatcaggtggaagttactatgttggaacttctgcggcagcagtgaacaaacattactgtgttggcggagaatgggcggcagcagttgtaaagaatgcttatttattaatgaatcgtttataattttctatttttgtattgattttatagaatcacaatgctataatttacaagaaatcaaaaagaagaaaacgttgatgagaagagtactttgtggaaagcttccagagagggatacatttgctgaaagtatcctaagcagacaaacaaaggaagaccacctcggagtggctgtaaaccagcccggctgacaccgttaatcgtcgattaagtgatctgtttctggagtttatgatcaaaggatatgaaacagataaccagggtggaaccgcgataactcgtcccatggatttttattagtccatgggattttttatttctgttatagatttattatagaagaaatctatagagaattgtgacaggataaataaaacgttatatatcaagaaaggatgaataagaagatgaagattacattaaaagatggatctgtaaaagagtatgaaaacaatatgtctgtcattgatattgcaaaagatatcagtgaaggactggcaagagttgcctgtgcgggtgaggttgatggagaagttgttgaccttagaactgtcattgacaaagactgcgaattaaatatcttaacatttgattctgatgaaggaaaacacgcattccgtcatacagcatcccatattttagctcaggcagtaaaacgtttatatccagaaacaaaacttgcgatcggaccttctatcgacaatggtttctactatgatatggagaaagatactccatttacacaggaagaccttgagaagattgaaaaagaaatgaagaagatcgtcaaagaaaatcttgaaatcacaagctttacaaaacctagagatgaagcgattgcatttatgaaagaaagaaacgaaccttacaaagtagaattgattgaagatcttccagaagattctgtgatcagcttctatcagcagggtgaatttgttgatctttgtgcaggacctcacttaatgactacaaaaccagtgaaagcattcaaacttacaagtattgcaggtgcttactggcgtggagatgagcataatcagatgcttacaagaatctatggtactgcatttacaaagaaagcagaattagatgcataccttacaatgatggaagaggctagaaagcgtgaccatcgtaaacttggaaaagaacttggtctgtttatgatgagagaagaaggacctggattcccattcttccttccaaaaggtatggttcttaaaaacacattattagactactggcgtgaaattcatcagaaagcaggatacgttgaaatctcaacacctatcatgttaagtcgtcatttatgggaaacatcaggacattgggatcattacaaagaaaatatgtatacaacagttattgatgatcaggattttgcaatcaaacctatgaactgcccaggtggagttcttgtttatgattctgaaccacgttcatatagagatcttccattaagaatgggagaattaggtttagtacatcgtcatgaaaaatctggtcagttacatggattaatgcgtgttcgttgttttacacaggatgatgcacatatctttatgacaccagatcagatcaaagatgagatcaaaggtgttgcaggattgatcgatcaggtttacaatttatttggatttaagtatcatgtagaactttctactcgtccagatgacagcatgggaagtgacgaagattgggaacttgcaacagattctcttcgtgcagctttagatgatcttggacttgattatgtggtaaatgaaggagacggagcattctacggacctaagattgatttccacttagaggattctatcggaagaacatggcagtgtggaacgatccagcttgacttccagctcccattacgttttgaccttcactacacaggagcagatggagagaaacatcgtccaatcatgatccaccgtgttgcatttggatctatcgagcgttttatcggtatcttgattgagcattttgcaggtgctttccctacatggttagctccagtacaggttgaagtgattcctatctctgataagcatttagattatgctaataaagtacttgatacattaaaggcagcaggaatccgtgcagacatcgatacaagagctgagaaaatgggatacaagattcgtgaagcgcagcttcagaagattccatatatgttagttgttggtggaaaagaagaagaaaacgaagctgtatcagtaagaagccgattcaaaggtgatgaaggacagatgaagttagatgacttcttagctgcaatcaaagaagagattgctaatagagaaaaccgtaaggttgaaaaagaagattaattgtcaaatgaaaaggaggcaccacatttgtggaatgcctccttcctttatatcatatccgttctaataattcatcaggtttcatagcagttactttactttcgataaaatccttgatattacgagttacaataaaatctactttcattcgctgtgcgcataccatttgaatcgcatcttcataatcagaagttttcatattcgccgcttttcttatatcagaagactttagatcagcaatatgaaaaatcataaacagctgttcaataatttgctgagttttttctggtgttaattcttttctcaaaatataaacaatatttggaatagataatgctgaaatatatccatcaattttttctacttcacataacttccagatttttgaagagctttctacaaaatcagttctgtcacataatacatcaaggattacatttgtatcaatcaatattttcatatttttctgcaatcctttctgcgcggatatccttttcgttataatctttttttagaattccagttaaagaatcagtcaagaaagaaatacctgtgtcttttgaaattaatctggcgacttcttttcctttctttaaaataataatttcattaccttcttggacagcttttaaatatttaccaaagttattttgaatatcagttgctgttgttgtaatcatagtatcacctcctattttaatagttagtacctaaaattattatatgctattttagggattttatcaatgatattagaaaaattgattcattttataagttatataaaacaagattgtctatataactgcaacattttctcaaataaacatcttgaaatataccctaacagggtatataatatcaaacgtaaaggaggaaatcacatggaagaaaaaaaagaatgttgttgtcatcacaagacaaaagaacgttcagacaaagaatataaagatcttattaatcgtctaagtcgtattgaaggacaagttcgtggaataaaaaagatggtagagaatgatacttattgtaccgatattttagttcaggtatctgctgtcaatgcagctttaaatagtttcaataaagtccttcttgccaatcatatcagaacttgtgtagcagaagatatccgagaaggaaaggatgagacgattgatgaattagtaaaagttctacaaaaactaatgaaataacaatttgacaagcaaaatgaaaggaagggaaaccatggaacaatatcaagtgactggcatgagctgtgctgcttgcagtgcacgcgtggagaaagcggtttccagtgtagaaggagtcacatcctgctctgtaagtctgctgacaaactcaatgggtgtcgaaggaactgcagattcatctgtgatcatcaaagctgtggaagatgctggatacggagcaaagaagaagggcgtgcaaacgcagagtaattcttcagatgcagatttattaaaagatagagaaactcctgtcttgaagaaacgactgatcacatcgttatgttttttgattcctttgatgtatctgtcaatgggacatatgatgtggaactggccgattcctaagattttagatggaaaccatgtagcaatgggtctgatccagttgttatttacaacaatcatcatggtgatcaaccagaaattctttattagtggatttaagagcttattccataaagcaccgaatatggatactttggttgctttaggatcagcagcttcttatggatacagtgtttatatcctatttgcaatgacagatgctcagatgcatcaaaacatggatgctgtgatgaaatatatgcatgaattctactttgaatctgccgctatgatcctgacattgatcacagttggtaagatgctagaagcaagatccaaaggaaaaacgacagatgctttaaagagtcttatgaaattagcaccaaagacggcaattgtgatccgtaatgaacaggaaatagaagttgggatcgaacaggtacatcaaggagatatcttcgttgtaaaacctggagaaaatataccggtagatggtatcatcatagaaggaaacagtgctttaaatgaatctgctttaacaggagaaagtatccctgtggataaaaaagaaggagataccgtatctgctgcaacattaaatacatctggttatctaaaatgtgaagctacaagagttggcgaagacacaactctttctcagatcattcagatggtcagtgatgcggcagcaaccaaagcaccgattgcaaaggttgcagataaagtatcagggatttttgtcccaactgttatttgtattgcaatcgcaacaatgatcatctggctgcttgtcggacaaagttttggatttgcacttgccagaggcatttctgtattagttatcagctgcccttgtgctttaggactcgcaacacctgtagcgatcatggttggaaatggaatgggcgcaaagcatggaatcatgtttaagacagccgtatccttagaagagacaggaaaaacacagatcatagctttagataaaacaggaacgatcacaagtggaaaaccacaggttacagatatggtaccggtagaaggtatcagcgaagaagaattactttccattgcatatgcattagaaaagaagagtgaacatccgcttgctcatgcaattttacaaaaagcagaagaggcgcagattcatgacaatcttgaaattaaaaactttttggcggttgcgggaaatgggctttctggaaagattgataaagagacgatttatggtggaaaccagagatttattgagaaatatgcaaaaattccattatctatgatcaaaaaatcagaagaacttgctaatcagggaaaaacaccattattctttgcgtgtgatgaacagctgattggtatcattgctgttgcggacgttatcaaagaagacagccctcaggcagtcaaagaacttcagaacatgggaatccgtgtggttatgctaacaggagataatgaacgtaccgcaaaagcaatcggtaaacaagctggtgttgatcgtgtgatcgcaggtgttcttccagaaggaaaagaaagtgtcattcgtgacttgaaagaaaaaggaaaagttgcaatggttggtgacggaatcaatgatgcaccagcgcttacaagagctgatatgggaattgcgatcggtgcaggtacagatatcgcaattgatgctgcggacgttgttttaatgaaaagccgtttgagtgatgtacctgcagcaatccgtttgagtcgtgcgacactgaagaacattcatgaaaatttattttgggcatttatttataacatcatcggaattccattggctgcgggagcctggtatatgttacttgggtggaaactaaatccaatgtttggagctgcagcaatgagtttatcaagtttctgtgttgttaccaatgcattacgattaaatctctttaaaatgcatgatgccagcaaagaccagaagatcaaaaacagtgtagtacttgaagaaattcaggttcaaaatataacaaaacaggaggaaaaaacaatgaagaaaacaatgaagattgaaggaatgatgtgtggacactgcgaggctgctgtgaagaaagccttagaatctttagagggtgtagaagaggcaattgtaagtcatgaagaaggaacagcagttgtttctatgacaaatgaagtgtcagatgatgtcttaacacagacagtagaagataaagattacaaagtgacagaaattgagtaaaaacaaagattgttataatattttgacataattcaagaaaatataacaacaaaaaatcaatattgttatataaaataatgataaatttgcaagatgtatgtagatttatcattatttttttatataaagcactatcttgttgagaaaaattatcaaaagtgtggtacaatatgactggttagaatcatctaatcaattacaacaataaagatagataaaggatataaaaaatgacactaaaagaattacaaatcggtaagagtgcagtgatcaaaagcgttggcagtcatggtgcattaagacaacattttcttgatatgggaatgatccctggtgttgaaatcacagtagtaaagcttgcaccaatgggtgaccctatggaagtacagattcatgggtatgaactgactcttcgattagaagaagccgatcagattgaaattgatccaattgtagaaagaagcagaagtcataagggtgcggaatatatgagaacttttgagcatccgggattaggggaagaaggtaaataccattccaaagaagatgaacatccacttccagagggaacacaattgacctatgcattagtcggtaatcaaaactgtggaaaaacaacattatttaatcagttgactggtgccaatcagcatgttggaaattttccaggtgtaacagtcgatcgaaaagatggtgcgatcaaaggacatcctgaaacaaatgtaacggaccttccaggaatttattcgatgtcaccttatagtagtgaggagattgtttccagaaacttcgtactagaagacaaaccaaaggcgatcattaatattttagacgcgacaaatattgaacgaaatctttaccttactatgcagttattagagatggacattccaatggtggtggccttaaatatgatggatgaagttgttgggaatcaaggatcgatcaatgtcaatgaaatggaatcattgctaggtgttccaattgttccgatttcagcggcaaagaatgaaggagtcgatgaagttgtaaaacatgcacttcacattgcaaaatatcaggaaaaaccattgcggcaggatttttgtgataaagaagatcataatggtgcagtgcatcgttgtattcatgcagtaatacatttgattgaagatcacgcggaaaaggcacagataccagttcgttttgcagcgacaaaagctattgaaggagatcctttgatcttagaacaattaaagcttgatcaaaatgaaatggaaatgttagagcatattgtcaagcagatggaaacagaacgtaagttagatcgaagtgcagcaatcgcagacatgagatttgattttattgagagtttatgtgaacagaccgttgttaaaccaaaagaaagtaaagaacggattcgaagtgaaaagatcgatcgagttctaacaggaaagtatacagcaattccttgttttgtaggaatcatggttttggtattctatcttacatttaatgtgatcggggcctggcttcaaggaatcttgcaattaggaattgataaaatctcagtgcttacagatcaggcattaactgcggctaacgtgaatcatgcgatccatagtctggtgattgaaggaatctttactggtgtaggaagtgtattaagctttttaccgatcattgtaaccttatttttcttcttatcattaatggaggacagtggatacatagcaagagtggcatttgttatggataaagtgcttcgaaagattggattgtctggacgaagcatcgttcctatgttgatcgggtttggatgtacagttcctgcggttatggcaacaaggactttaacgagcgagcgagatcgtaagatgacaattcttttaacaccatttatgagctgtacagccaagctgccaatttattcttttttcgtgaatgccttttttccaaaacgtggtggtcttattatggcaggattatatttatcaggaatcatgataggtattttgattgcatttttatataagggaacgttatttaaaggagaaccagtgccatttgttatggagttaccaaattacagacttccaggagtgaagaatgtagcacaattattatgggagaaagcgaaagatttcttacagaaagcattttctgtgattttggtcgctacgatcgttgtatggtttttacagagatttgatctgcagttaaatatggtagaagattctgcacatagcattttagcaatggtagctggtgtgttagtaccagttttttcaccattaggattgggagattggagaatcgtgacatcattgatcagtggatttatggcaaaagaaagtgtagtttcaacattaggagttttattcaatggaaacatcacagcggcgatcacaccattagccgcaagttctttattagtatttagtttgctttattctccatgcgttgcggccatcgcatctgtaaaacgtgaactaggaacaagatgggcggttggtctggcattatggcaatgtatgattgcatggattgcagcattaatcgtaagattcattggattagtaatttgaattacataaaataaaaatatcgagagaggccagtaaaatactggcttctctgtcttttatcagcaatctataatttaaatcggtattttgcgtatagattgattcttaagcatatggcactttcaaggtctgttctctccatattttatatcattattgtcaaatgtaaaaaaataaaggaacattgaaaatcttattccaattccatgttcctttatcattcagatgttatttagaaacttaaatgcttctttttctttaacagattcgcacctgtgatgatcagcatgattccagatgcaagtccaatacaaatggataagattccaagcacgatgtttccagcaccggtacgtttcattgttaagtagattttctccatgtccatgatgtgacctccgtttgagaattataatttgtaatgtctatgatttactatatcattaaaattcatacttcgtcaaataacaacttataaaagcagatttcttaccattgcaccatcaaatgttacactattcatatggtggacttcaatctgatataatgcattggctgcaatatgttctgcggcttgttccagatctctgattcctgtggtttcagaatacatcttaatgacagcatctaaggcctcatctgtcataatacattcatcatcttttaatcccatacgttttaataccttagggagtgcaaatctttggaagatcgctttcttctcttccggtgtgtaatcagggatgtcaatgactgcaaaacgtgacatcaatggtgcactgatctggtctttttcatttgcagtggcaattggatatactccaactgttgggatcatacattccatataattatcggtaaatccgagattatcaagcaatgttagtaaaacatctgcaggatttccatttccttttcctgaattggctttatcaagctcgttaatgataaatacaagatttgattctcctgccatggaaaatgcatccatgatgatccctggttttgcatttgcataaatacgggaacttcccgttaactgctctggatcgttaatggaactcatatcaagagttgtccatggaagttttaaaattcttgcaacagcataagcaatctgagattttcctgttccagcaggtccaactaataataatccataagcaggcagcgtgtgtgtacgattgatctgaatgatcgtttcaatgattctttgtttcacacgttccataccatagagttcttcatcaagaatccgtcttgcttcttcaggatcgatcgctttaaaataattactcttccattggatgttcatcatgatggataatgcacgctgggcatgacgtctctcttcttgtgaaacttcatgagattttgcaacagcaagatttcttcttgcccatagacgaatattatcaggcagcgtacttccggcacatgtcataaaatctgtgatactctggatgctggtaagtttcatatcatcacccatctcatcaagattttcatcagtgatccgttcatctggtgcatcactttggaataaacgttcgatcataaactgaaggaaaccatcttctgcagataatttggtgccaccgccaagagcaatttctctgatcttgtatacacaataaccttctactgtattctccccagataagcggacatgaatatgattctctccaagccatctgaccaggcttacaaaacgggaatctaattttaagatatcagatattactgtcccatcttctccctcaaattcaaaggctgtctgcttatcttgatcagaaaatacaccacaggaatgatgctcccactgcttcttcttgtttgataaaatcaagatagggcattctatcgtagcatgatctacattcgaagaaaatgttgtataagtacagactacttcttcttttatttctgatgtatcgttactaaaatcaaatactggcataattaaatactcctgttttcttttgtttagcatatttatatttcattatatcagtttttcttgatttttaaaagttttaaactctttataaaatagaaaaagggataaatgcttctggatgttctttatgttttccaatatatttttccatccagaccatatcataccaacgtccgaatttatagccgcttttataaaattttccaaccatatgataaccaagatgttcatgatactgaacactgttttttgtaacatattcatcttcgatttccggatctgtaatgcacgcatccaaattgatcacatgttgttttcgaaggatttcttctaatgcctcatataattttttcccgattccctgtcgttttacatccttatctacataaatggttgtttctacggaccagtcatatgcagcacggtttttaaaagatgatgcatatgcatatccgacaatctttccatgcccatcaacagccgccagataaggatagcgttttaatgtctgtttgatcctttgacggaattctgttatcgaaggtgtttcatattcaaatgtgattgctgtatgttctacataatagcggtaaatttccagtaattcttctgcatcctgtggagttgccaatctgacttccattttgtcattcctttcagtttaatgaaatagtggtgcttttttatttaattttgcatttgaatgtgttccccagtgatcacttcataacaaatcagattttttgtgtttaaatcttcttttgtcatatcaacagcactgatctggtgattatcataggttgtataatagtagattcctttttgcgtattacaacaagaagtatataaggtaatctcatattttccattgacatcgcagcatcctctttgctgatcgacagatccaagaatatggaaaaactgattgacactttcattttcagaatctccagagacagaatgtaatttggtaaatgctactttagcaaaacgtgaggatgaagaaagatctccaggaagaccaatcgcacccattccacgactgtattgatctaaatcgatatcttttgcaaatagattttctggttgttttggagaaagattcatatattgatttaataagaacatctgaatgttaaatggaggattatttgttaataccccaacgttattttcatagatatgcatcccatcttccattgcttcgactgtgatcgcaccagattgatctgcaatgatccagtgaagctgcgctaatggaaattgttcactgtaaggggtattggtaagattcatatgaatcaatgctgtcttcgcttcctcaagatttgcacaagttccaagaatccaagggataaattcaaactgtgcgatattgtctttaccttcttctatatcataatatgctgcatttccaacaaaattaagcccagccattgccagtccacattcattgaatgcatcataatacaaagggtcattgtcgactacatgagccattccgatcatagcataatgactttctatggcatcgatatgtctaaaatgaaatggataatttcttggagtgatcacaacctcatctccataagagaattcataatctaaagttcttccaaaataaaaatcttttgtcttgtaagttgcagctgtacacattgctcttttactcctccttctattaattaatttcaatgattttcagtaataattatatcctgtttctaaggtatcattcaaagatgttatgcctgatctgtcataatggaattattttcaaaaagatttcgaatgctagtcgttatctttcggaataactggtcaaatccataagcataaagagagccaaagacattggcagcgattcttaggatgatggcattcctcaggccaaaaagattctctgcaatataaagagccccaaaggtgttgaaaacggtttgccaggcatatccagcagaataaccaactcctatcccgccgatcagaccgatccattgaaagatatgatcaggaaggatcgcatgtaaaataagaaagatcatacatccaagaatattaaatggtcctcttctttgtacacggtatttcatatcttttgaaaatggcaacaggacagacattgcagcaatcccgatccacataactcttggcatatgaaccaattctccgatcaacattgcagtagaaattccaagagataatcttaaataccagctgcttcttgcagaaaacagatgaaattccttaaataaatgataaaatcctctatgaaatgttcgatttctatgattcttgtaaaatacaagggaacagatcacagcacctacaaataatccgcaacatcttaacacatagttatgccctgtaacatcatatccatagaataacaaatatcctaagataaatgtggactgattggacatgataacgttatggcagcttaagatcatgatcgccataatacaaagaaaatgaataaaaaaagcaggaacagtatttacagtattagcgagtcttggtccaatcgcaaggattgcaaaaatcataaagataacgccaatgctgtgttttgtatcgattccgaagtcaacctgtcgtaagatcattaaaaccagtaagactagcacgccgacaacactgttttgtgatccaaagatcatactgtaaagagttactaatgcaaaacaaaatgcaacaactaaatatactttaaaattatagataaggatacgtttatgtttctcttttgaatctttggcacctttgatccattgtttggaaccgatggaacttaattgtaactgttgataaaaatccaatgttaatacctcctgtgataagaatctgtttctgagtagcaatgaacaattttactcacttctaggctgttcgtcaatacgttatttgacgttttttcttatttttgatatgatttatttatgaaagcgacagacaaagaaaggagaatttatcctcatggcaataaattttaatcagatgttaaagtttcagcagataaaaaatgcattcaaacggtttgatcaagatcatccaaaattcaagaatttcatgaatgctgtatggagagagcaggcacttaaacaggatgctgtgatcgagatttctattacatctccagaagggaaaaattattgttcgaatatcaaactgaatgcagcagatattgagatgtttgaacagttgaaatccatgaaaccagaataatttcaaattttaatgtcaaattaatgtcaaattaatgtcacggaatcccgaaaagcaaaaatttaatgtcacaacccaaaaagaaggctagtcaaatttcacgactaaccttcttgatttttactgtaattcttcctcagacaccagatttttcatgcttctaagccctatacaaagggttgaagtattatgtaatacggcagatgttgttggctggataaagcctaacacaccggccccaataagccctgcgttaaatccaacaataaagcggtaattattatgaattcggcgcattaagtggttactgatatgtttgagagttaccagaccatgtaaatggtctccttcaatcgttacatctgcgatttctcttgcaatctgagctccatcactgatcgcgattccaacattagatgcagataatgctggagaatcattgattccatctccgatcataataacttttcttccttcggctttttctttctcaacgaaagcagctttatcctctggaagtacctcagcatgatattcatccacaccaactttggctgcaataacctttgcagtacgatcactgtctccagtcatcataacgactttcttgattccagcagcttttaatgctttgatcacatctttggcttcttcacgtaatgggtcttcaatacagatcacacctgcaagttttccttcgatcgccatatataaatgcgaacattcttcaggcagtttctcaaataactcttctttgccttcaggaattgtacactgctcatcttcgaatacaaaatgataacttccaatgacaacttttttattctcaatcatggaagaaattccatgagccacgatatactcaacctcagaatgtaattcttcatgtacaagatttctgtcaacagctgcctgaactacagcttttgccatagaatgagggaaatgttcctctaaacatgcggcaattcttaataattccttgcatttcattccgttaaatgaaacaatatcaagaacagtaggttccgcttttgttaaagttcctgttttatcaaaaacgatcgtttcggcttctgccattgcttctaagtatttaccacctttgacaacgatctgatggtcatttgcttccttgatcgcagataaaacagagattggcattgcaagttttaatgcacatgagaaatcaaccatcagtacagataaagcttttgttacatttcttgtaaacaaatatgtgagagcagttccagccaatgtataaggaactagacgatctgcaagatgttctgctttactttctaaagaagattttaatttttcagattcttcgatcatcgtaacaatcttgtcaaatttgcttgatccatttacttcttttacgcaaacttttaagtcaccctcttcaacgacagttcctgcatatacgtatccgtcaggaatcttgcgaacaggtgttgattctccagttaatgatgcctgattgaccattgcttcaccatcaacaacaactccatcaaatgggatcatatttcccatctgtatgtgaacgatatcgttagcatcaatttcgttggatggaactaaaatctcatgatcttcttcgactttccataccttatcaatattcaaggacatgctttttgcaagatcatcaacggatttcttatgtgtccattcttcgagaatttctccgattccgagtaaaaacatgatagaggatgcggtattgatatctcttcgaatgatcgatactccgattgccgtaccatcaagtactggaacttcaatcttaccctgagcaagtgtatgtattccttcatatatatatttcacagatttgatcactgtgatccctgctcttaatggatatggaaataataatttgtttccataatggaataagactttacttataagtttctcctgatatgtctggtttaattgtctgctctgactttcttgataattatcagggactgtgatgattccatgataaaattcctttaaagcagtaagaatttcactgcggctggcatcataacagatcacgatgtcatttgtgcggtcatagatttttacagatgttacaaaatcttttgttataagataatattgaagttcatctgcctgatcagcactcattgtcttctggcagttatgaatacgaattctgcctcgaatctcatgtttgatcgtaaatttcatacaaactcctttttgtttgaaaacacctgcaggaaaactgcaggtgccttaatcttctattctattctgcaacttctttgaaagtatcttcggaaacttcttctgtttcttccgcctcatcagtttcagcataagcttcccattcctctgcttctgctgctctttcttcattgatctgctgagcttcagcatagatatcttcagcattctcctgtacagttgcaactgtatccattacacattcttttgcacgaagaacagctgctgtacaatttgtgtaaaatttctttgcatccttacttgataatgctttaatacctgctgttccaaataaaacgcctgctgcaaaaaatcctgtttttttactctttactactgataaaacttttgttaaatccatggttttttcctcctgtatgatataaatatgtatttatttctcgtatacttaagagctatatgactttatatgctctctaagtaactttgtccattataaaacatcctatggcgattactcaagactaatcgcagtgccttattgataatatttctcaataagcgctactctccttctgtagtgtcagagctgttaaatatgttcccagaatcaccttttgaacggttatagtcgtatttggaaggatatccacatgtctcagcagcatctgcacctccataattcttagcaaaatcctgacgttttcctttattaaacataaagtattttaatgcttcctgatttgctttgaaatttacaaagaaaacatatccacatggaggatagcttccagcaacagctgttttgtatgtattctcgatcggtacacgaagctgatcaatctctgttgttcccatttttgcaacagataggatcagtttcttaatataagttgcatccatatccgtagatacatcaccaagtgcatcaatcgcaatatccacaagatctaaaggattttgctgtaacatcttctggaaagttgcctgcataacagcacgctgtcttcctgttcgtccaaactcttcaacaccatactttttagagaacacatgacgaactcttgcataccctaatgcctgattaccatttaaagtctgtttaccgacttttacatttcgatattttttctttgaaatataatttgttgtatttaagtattctgcttctctttgttcaagagtcatttcaattccgccgatcctgttaattaccttttcaaatgcggcaagatctacaacacagaatttgtcgatcttaatattaaaattttgagccagtgtctgatataaaagcgcttccccgccaaatgcataagcggcatttagtttattacgtccatgacctggtatttctacatacatatctcttaaaaaagaagttaatttcaattcttttgttttaaagttgatcgttgcaaccatcatactgtcagatcgaccatgatcacctttttcggagccctgagccccattatcagaaccaactaataaaatattgacaacatctttatcgaaggtcagatcttcctcattcttaatcttcactttatccatagattgtttttttggtgtcactgcggcttccagccgcgcatcataatacccaagcataccaccaacgccaattgcaatgatcagaaaaaaactgattatgactgtaaatttttttgtaaacattctaaagttccctccttattttcctgtccgtattttaccacatattcttttgatatcaaactgttaatctttgtttttttcatttcctaagaaaatcttcagaattttatccatatcattttgatatggatataatgtaaaaaatgtattttacacttgtttttattcatgataagataaaaacatattaagttaggtaactagtttacactttttatatattgttctgagaaatctccagagataagcaacgggtgctgttctttggagattttttaatatcataggaatttccgatggaatcccctaatttaagaatcttaagaatgccttagctgcgatactttgtggatattctgtatcatagatcaagatgatattacgctgagggaacgtttcttttacctcaatctcaaagacttctccagattccagatcatctttagcaaattctggtgggataaaaccaattccaagattatgtcttacagctggaaggatcatatctgtagttgcaagttccatatctgcctcaaattttaatccattcttttcaaaatactgatttaaaaactttcttgtgatagcttctggggtcagactgatccaaggatatttggcaagttgcttgatagaaattttttgaccttttaattcctcaaaacgtttcccaccaattaaaatatcatggtattttcttaaaactttttgctgtaacggtttttctatttgaaatggtgcagatacaactgcaaaatcaacattgccttcttttacgatattgatggattttcttgtactattatttaaaatcttaaaatgcacattcggatattgttcattaaaagattccattgcctgaaataaatagcaatgcagagcggtttctgtcgcacttacatagattgttccattttcaaggcttagcatatcacttaaattgctctctgctttaaaaaactgagcacatccggctgcgatgtattcataaaaaacttcaccttctggtgttaacttcataccaactttgcttcgttcaaataatctgcagtttaaattcttttcaagattatggatcgttcttgttacggatggctggcttgtgtgtaaaactgtagcagctttcgtaagattcccatattttgctacataataaaaaatccggtaatgttcaaaatttgtattcatcgttttatttccttttcgcaagctgccagaatgcaacagcactcgcagcagctacatttaatgaatctactccatgtgccatcggaatctttactgtatagtcacatgcatcaatcgtttcctgacataaaccatcgccttctgttccaaggatgatcgcaagtttatcttctgacatcaaagcttcgtcatcaatacttacagatcgggcagtcaatgccatcgcaacatttttataaccaagttcttttaaacgatgcattccatccgctggccatgtatcatccccaagaaatgtccatggtatctgaaaaacagttcccatactaacgcgtacagatcttcggtataatggatcgctgcagcctttactaagcagtatggcatccatattaagtgccgcagcagaacgaaagattgctccgacgttggttggattcataacattttccagaataacgattcgttttgcatgatcacagatcgtttcgagcgcaggtaatggttttcgacgcatggcacacaacatgcctcttgtgagtccaaaaccagttagttgttttaatacatcaaaagatgctgtatagacaggaatatcctgatattgcaatataatatcttttgcctgtgttttaatatgacgatcttcaaccaaaaaagaaatcggttcatatccttgttcaaaggctgtctgtataacctttgggctttccgcaataaaaatcccaagatctggttcataataatgtaataactgcccttctgacaatcttgcataaatatctagttgtggatcgtttagatccgtgatctgtatgacagacatcttatcttacctccatgtctttgttctgaaatgtagctttaaaatccacattattatatcgtatttcacaaactaaatctacaaaatataaaggatttgtgatataatgaatcttcaaacacatttcaatcaaaggagaaattactatggataaccagaacatcctggctgttgttgccggagaagaaatcacgcagaaagatttagatgcactgattgctgcattaccaaaagaacaacaggcatatgcagggaatgaacactttagaaaccagtgtttagaacagatcattactgttcatcttttcgctaaattaggagaagaattaaaattagaagaaacagaagctttcgctgacaatttagctcatgcaaagagagagattcttgcacagatggctctcggagaggctatgaaagatattactgtttctgaagaagaagcaaaagaatattataaagcgaatgaaaatcagtttatggctggagaaacagttcatgcgaagcatattcttgtagatgatgaagacaaatgtcaggaaatcttagaaaagatcatcggtgaggaaactacatttgaagatgcggctaaggaattttcaacatgcccatccaaagaaaaaggtggagaccttggtgcatttggacgaggacagatggtgaaagaatttgaagatgctgcatttgctgctgaagttggacacgttgtaggtccagtaaagacacagtttggatatcatctgatcaaagttgaagataaaaaagacgcagaaacctctgtatatgaagatgttgctgatacgatcaagaatatcattcttcagcagaaacgtaacgatgtttacggaaataagatcgctgaattaaaagaaaaatatgtagaaaaatagaattttcttacatagtgtaaagtataaaaagatgccttccacaaaaactttatgggaggcatctttttgaatgtttaatttttattacatgatcaatcttttaaatctactacgttattctacaccgtaatgtgttaataaggctttttctgcttctgcgctccataatccattatgtctgtcacaaatatcagcaagttcattgaaaaaaggatcatcttttgcaagacttctaagatcagaaattgctgtcattggcatattgatatgaagatatgataatttctttccacctggaatatttggaagattcattgttgtatcaacgatagaatcaattcctccaacatgagtgatcataacagctggtttgatttcttttcttgcagcacgatcgattgcttctttcatgtcatcgatacttccaccagtacttccaagaatcttcgttgcattgtaatgacagtcatacagattcacatctgctgaaaattcggagtctgttggtcctgcaaacaggttcatacatccatcatagcctaaaatcttgtttccaagttctgcaactggtctggctggtacgtaaacaaagacatcatcaaatccttttccatcgacagatagtgcttttaatccatcgactggatcatccatctttgctgtgtttacataaattaattcaacacctttttccttggcttcttctacagagatcacctcattcgctcttgctaatttggcgtcatcaatgtctgtaacgatcactttggctggtttattctcgatggcaagggcgtagcttacagcaccaagtcccattggtccgcatccaccaagaattgcgatacttccacctgcttttgttcccattacatgttcataacggtctttaacgtgatagtttgttttataaccacaaatgacacagcacattggttctgcaacagaagattcaaagtaagaatctccttcatgagtccaaaggcatccagcttcgataatatcatttgggaaaatacagtaagttgctgctccaccgcactctgtataagagtatcctggagattcagcctgtccaggaattgctggctgctgtgcgaacttctgtcctggtttgaatttatcctgccattttttaccgactttcacaatatctccggcaaattcgtgtccaatgatgatcgggtgatcagcaacatccgcaggaactcgcttatgatctgctccttgttttaccattttccatgtagacatacagatcgaatcactcatcaccttaacaaggatctcatcgtccttgatctctggaagttcaaattcttccagacggatatcgtcttttgcatataatcttacacctttaacttgcatatgctacctcctaaaatataaaatccatacaggtatattttagcacaaggaaattattttttaaactcgttttcttgatatttatctacaatatgattaaacattgtgcgaacagcaggcgccataaaattcggattcatagctgcaagtccgatgatcctgcttgcaggtggttttgttggataactatcaactttatatggaatatctgtcataacaagtttcggcatcagacagattccaaatcctttctcaacaagtgcgatcgttgataaatcatcaactacatgatagttcgattgtacttgcagcgaattctcttttaagaaattctggatatctgcatcggtactgtctcgttgtgttacaaattgatgatgtttcatttcttcaatatcaatataatttgtacttttatttgcttttgtaccactcggcagaacacagagtaattcgtcacgatataatggttcaatcggaatatcctttgcactggatacggataaaaatccgagatctacaactccgttcttgatccagtatacaacatcatcgtaagttccctgaaagacttcaatgtcaatctctgtatacttcttcttaaaagaatgtaagatctctggtagccagctggtacatacactggagaatactccaatctttacttttccttgttttaatccatttaattcagcaatttcctgctttaagctttcatcacagttcaatacagcatttacatatggtaatagctgctctccatagtttgtgagactgactcctgctttgcttcttgtcaatactgaaaatcctaattcattttccatcgatgagatggcatgactgatcgcagagggtgttaatcctaagatatccgctgctttatggaaactccctacatctgcgattgtcttaaaaacttggtatgtcaataatgtcattccataaaacttccttactttattattttatctatcacatttatataacagattttcccaacgtctgtcaacctctttctggaattcttcaattaaatgttcatttccaggtttaaataaatgtttaaatcttccctgtgctcttaagaaatcttcaataggaagttttttctttggctcgtaagttaaattccattttccatgatctacttcaaacattggccagtagcatgtttctactgcaagacgacagatttccataatatcttcagtattgtatctccatcctcttggacatggtgtcatgatatttaagaaacttgccccttctgtgtaaatcgctttttcagcctttttatgaagatcattaaagtttagtgtaaatgtactctggcctacatatgctacatcatgatctgcgatgatgcttgcaaggtctttacggttctgcattttaccaacagattcttttcctgtcggtgttgttgttgtatctgcaaacattggtgttgcagaagatctctggattcctgtattcatataagctccgttatcgtaacacacataaaccatgtcatgaccacgttccatagctcctgataaagactggaatccgatatcataagttccaccatctccaccaaatgcgatgaatttaaagttttcgtcttttggaagttttccacgtttttttaatgctttatatgctgtctcaactccacttaatgttgctcctgcattttcaaatgcattgtggatataactgtcttcccatgcagaatatggatacatgaaagaagatacctcaagacatcctgttgcatttgcgatcacagcatgatcttcttcatgtaaagcacgaagtaccgcacgaactccaattgtagcaccacatccggcacacatacgatgtcctggagctaaacgctcttttttactcatcatttcttttacattataactactcacagtattcctcctattaacgcaatccgatgtatttaaactgttcaagttttgttccattttcaatatgatcttcaagatcagcaaagatatcatatacttcctgtacggtaaagtctcttccggcaagtccgtaaatatagttgacggtatcgatcatcactttatttctaaataatccggcagttacttcacttccaagaggtccaccgtttccgttataactttctgtacggtccatgattgctaccgctttggcaccttttaaagctgtggctaattcatcggctgggaatggacggaacagacgcagtttgataacaccgacttttttaccttttgctcttaagtcatccactgcctgttttgctgttccagcagctgatccgatcaataacatgatgtaatcggcatcttttgttttgtattcttcaaataatccatagcttcttccagaaatctttttaaattcttttgcaaccttcaagactgcatctttcgcattttctaatgcgatttcttgatttttctttgcttccattgcatagcttgtcacagaatatggtccaactgcgattggttttccaggatttaataagaattcttccggttcatattcaccaacaaaatttttaacttcttcatcttctagtaattcaatattttcaaccgcatgacttgtgataaatccatcctgacagatcatgatcggtaaatggactccagcactttcggcgattggatatgcctgaataaagttatcataggcttcctgattgttttccgcataaatctgaatccatccagtatctcttgcgcccattccatcagaatggtcacagttgatgttgatcggtccggataatgtgcggtttacgagagctaatgcgataggcatacggtttgatgctgcaagcaataattcctcccacatcaatgcaagtcctgcagaagatgttgctgttaaagttcttgcgccggcagcttctgatccgattgcggcactcattgcagaatgttcactttccacagggacaaattctgtgtcgatttctccatttgcaatatatgtagaaaccatctgtggaatctctgtggatggagtgattgggaatgccggcataacatccggattgatctggcggattgcgaaggataccgcctcatttcctgacatacgatcttttctagccatcttatcttccctccttcattgtgattgcatcaaatggacaggcttttgcacaaataccgcatcctttacagtggtcataatcaaattctactcgttcaccatcttttagaggaatactagagtctggacagaccatggaacagaccatacattgtctgcaaagatcctggtctaaaattggtgttcttgttctccattcccctgtatgaaactgttttgaagttccgccagcaaataacatcagtccttctgtcagatcctgatgaggtgtctgctcattgattttgcttatatctgttctcatattgttatatctccatttaaaatacgtttttataatacatcttttaattcttcataagttaattcaagtgcctgcatatttccatcgatgacttctggtttctttgcaaatttatgctgataagaagctcgcatttcagaaataaaagcatcttttttcataacaccactgactgcaacagctgctgcgagcattggagagtttggaaaatattttcctaaagcctgtatagagatttttcttgcatcgacagtataaacttttccttgatagccatttaacattggcttgatctcatcggctgattttggtgtatttacaatgatcgctccatcttcttttaatcctgctgtgacatcaacagagtgaagtaatgtctcatcaacaacaactactaatcctggtgtataaatgtttgaatgtacgcggatcacttcatcactgatcctgttatatgcagtaattggtgctcccatacgttctggcccgtattcaggaaatccctgtacatattttccggttttaaatgctacgtcggcaagaagtaatgctgcggtcttggcaccctgtccgccacgaccatgccatctgatctctagtccattgttcatggtgtttctctccctttattttgataattatacttaaatgaattacattcatctataaattagatttttttcagtaacattaactattatattacaaaatccgactttgtaaattgaaactttgaatagttttcattatatagttgaacaaaattcatttataaacaaaactacaagggaatacaacaaacaaaagttattgtattcccttgcagttttatattatttactatttttcttgattcgaggatcaaaacatctcatatcaatccacattcggctgatctttttatttgcctgatctccgaaatatgtcataacagcacttcttcgcataacatcctgtgtcggatattgggcatataactgtcctttggacatttcctcacttgttttcattacatagttgtaattatctccattttgttggaagaaataattcagatcataatcaacgcttttcttatcttcgcttccatacatatatttgatgtaatcatagatggtcttatcttctcctccagagatcacagatgtatatccgacatagtacatattccttacaacgttatccggtcttgaaatgtagtttacaaaagcctgtgctgcctgctgcttttctttatcttttccaatcccagactttaacatacaccatccgtcaaaccacagattcgtactcgcttttggaacagcataacgtaatttgataccttcttcttccacctgctgcatagaatatacaccgtctccagaccattgaagattagctaccacctttccactgacaaggtcagcttttccactgtcagtttcaaaagaatatacattatccttgatctttgataggatcattcctgcattttggatactttgatcagaagtatcatttaacaaggatgataatttttctttgtagtttgactggttttgaaatttctttgttaaaatctctttctgtgtctgcataccacgaactgcaaaataacaatccctgacactatctttggcagttatctttttatagtatttttgatttaataatagaccccagtcttctgcatcttctctggaaacatactttggattatatacataaccaagtgttccccacatataaccagctgtataatcccctacagactgcccttgatattttaactgatccaaagattttttaatataaggagatacccctttcgcataataattgttggcatctgaagtatcccaaaattcatcagaatattttaatattttattttcagccataagtttcatcgtcatatattcggatgggcagatcaggtcataagtgtcaccgatcgtcaactgattatacatatcttcatttgttccaaaagttgaatattcaactttcacttttttgtgatatgttttttcataccagttttcaaaatctttgatcatcgaatttcttccgatgatctttttcccattctctaattcgatttcttcatcatcgtcccagtcaccttcatccagatattcttcccagtttgcaattcttaagataatctcatcattttttgaactcttttgtgtactacaggaacataaagccaggggaagcgtgattacaagtaaaattgaaaaaatgatagaaaatactttatatttcatgatcattctccttcctgcctgtatggttcataccgatcacaacaaagatcacgatcaaaaagatgatggttgatagtgcccatagagctgttttaacatcagtctgtgctccttttgtggcattaacaacatacgtgctgatcgtgtcaaacatcgatggctttgtataagttgtgataaaataatcatctaatgttaatgtgatcgacatcataaatccagaaacgattccggaagttaactgtggcaacacaacctttcttaaggctccaaatgaggagcacccaaggtctagagcagcttcatataactgaggatccatttgctttaggcgagggatcacagatagatatacaaacgggctgcaaagggatacaagcccgatcacaagcggaatataacttgctttatccatcttaaaaaatacgatcaataacacacaaatagaaaaaccagttacaacatctgcatttacaactggaatctgattcatcagatggatcggtctctttagtttctttgaagaataaaaagcaccgatcgcaccaagagttccaaggatcgttgaaataactgcaacgatcacagctaagatgagtgttccaaagatcatggatctaaggtcttctgaatgaaacagatagacataattcttcactgtaaaacttccagatctgccaatgatcgcagaatccataaaactgtagacagctaagagcaagattggcagatacatcagcaacagaaccattccaaggaaaacactttgtattgtttttttattcatatgcattgtcctccttgtctgaaaattctcctgtgatcgtacttaataataagattaagatcaagaggatcatggaaataacagatccattgttccagtcatacatgctgaaatagcttccaacaagacttcccataatatatgtgctgttatacatcatatcaagcacaacgtaattcgtcatagacggaagaaataccatcgtgatcccactgatgattccaggaatagacaatggcaggatcacacgtaaaaatacgcgataagactttgcccccagatcttttgccgcttcaatataactatgatcgatcttcgcgatcgtattatagattggcaggatcataaatgggagaaaatcataagtcataccgatcacggtatttaggaatggatgaaatgcaagatttccttcgatcaatgtcaagatttcttttaatgccgtgatacgcaaagtgaagttgatccacataggcattacaaataacattaataaaacattccctcgccggaattctccctttgcaagaagatacgcaactggatatgcgatcaaaaggcagacgatcgttgtcacgacagcaaccatcacactgtagatcaaagttccgattgctttactgtctgtaaaaaacaatgtaaaattcgcaagagaaaactcacccgctccattggtaaatgcataatacagcaagatcaatactggacagacgacaaaaatgactagaaatagaaaatacggaatgcccagaatgctttttagtctatcatttttcattctgcatcctccgaaacactctcaaataccatggcatcttctggaactaccacactgacaaagtcaccgatattccataaatcttcatcatcaaccgaatattctactttattctcacttaaaactcgataattataatgatctcctttgtaaatgatcgagatgatatttccctgaaaatatccttcttccggatcatcacttaattttgcaagttttgatggaaaatacatttttaatcttgtaccttcaggatgtgcttttggctctttttccttcacaggaatacgaccatctgtaagttctaaccaaccatctttgtctattataccaatataatggttgactttgagatcctttggcatcgtatggatcgtatctgcagtaaaatcaaccccaacttttgttcctggtgttaactcgtgcaagatatgtgcttcaatttcatttttgtctgataaaacagccacttcataaaatttaccgcagaacagacatgagagtacttctccagtaaattttcctttgtctggagctgttaaaacaacatcttctgggcggatgacaacatctagtcttgttccaggttcatggtcatcatgacatacaaaatcatgatgtgcaaaatggatcagatttccttcttttttcataccatcaaaaatattactttccccgataaaatcagcaacaaaggcattctgtggtttattataaatctcttctggtgttccaacctgctgaatctggccttttgacataacaacaatcttatcagacatcatcaatgcttcttcctgatcatgtgtgacaaagataaaggtgattcctaattccttatgcatattttttaactcgatctgcatctcctgacgcatcttataatcaagggcacttaacggctcatctaataataagatcctcggctcgtttacgatcgcacgtgcgatcgcaatacgttgctgctgtccgccagataaactgtcaatctttcttttctcaaatccttctaagtctacgatttcaagcacacgctttaccttttttttaatctcattcttcggtactttcttttcttttagtccaaaagaaatattatcgtagatatttaaatgtggaaacaatgcatatttttggaatacagtattaaactttctctcatttggaggaagctcactgatatcctttccattaaataagatttctccactcgttggtgtttcaaagcctgctaacattcttaagatggttgtctttccgcatccggaaggccctaaaaatgtaacaaactctccttcatttatcgtcagattaaaatcataaataaccggtacatctttcgtataacactttttgatgtgttttaattctatgatcggttgttttttctccattaattttttataccgttactgaaaacttataaaaagttataaacctttatgtttcattcctacttcaacgagtatgcttttgtaacgaatcaattcatgtactactcacaagttcctgtactctccataggcgttaattcctgactaacgtatcagtacatatctgtaatcacttgaatatattatgctacagattgtttcagaacatcctctccatattttttaagattcaaagctgcctgaagatctctgtcaactacatttccacattcacatttgtaaatacgttctgataacttcagatcttttttgatctttccacaacaactgcataatttagaacttggaaaaaatcgatctgcaatgatcacctgaatattgttccacttagatttatattccatctgccgcctaaattcataaaatccctgttgttgaactgctttggataaatgtctgtttttcatcattccctttacatttaaatcttcgatacagataaaacttggttctcgttttacgatctctgatgttatatgatgtaaatgatcatgacggatattggttagtctatgatttaatattaataaaagtttttcctttttgatcacattcttcgttttacagtattcctttccttgtttattgttctcgtatgaacgagagatgctacgctgtaatctgcgtttttgtttctctagtttcttaacttttttcgttttattgatgttcttatatttattgccatcagaacatatcgctaaatctttaatccctaaatcgatccctatcccatcattggatggaacggtaacagagtcttcgtattcaatgcctactgtgatccaccagttgatcccatcatatctaatacggggattactatagttacaatccgtaggtatccgattcttttccgcaagtctgatccagtttatcttttgcttattcttctttttggaaacagcaaaaccttcaatttttacatgcctatctgaaaattggatctttacattatcctgataaaaagatggtatagaaaattttcggcttttgaatttaggaaactttgaacatcctttgaaaaatctcttatatgcatgacaagcatctttgatcgcttgttttgttacattatttgaaacttcatttaaccaagaatattcctctgttttctttaattgtgtaaattcttttctcagatcactatccgatagaaacttaccaccatttttatagttttctttttctcttcctaacgcccagttataagcgaatctggcagtattggcatattgaaagagttttgtcttctgtttattatttgggatcagcatgactcgaattgtttttatcatcttcttcaccaccatcatctatcagttcttttacaagttttcttgctttattggcacgtttgccttgtgatttacaactaaatacagttattatctaaactaaatcttcaacaagttcttgttgctctgtcttttcagtatgatcgatgatctcaatattacaatcatatagacttgcaatatattcaactaattcaaatccaaatcgtaacaatctgtctttataaaaaacaaccaccttgtccactttattttgagatattcgtttcataagttcttttctatctaaattaggttttacattcataacttgatttaattgctcatgcgaataatatctatatccattactggaagtgtgatgtggatgaagtttcccctttttatccccattccttaatgtttgagccgatacacctaatatttttgaaaatttattgatagaataatatttactcataaacaaattctccatataatatttataatttattataagattattttaacagttaaacacctccataatagatgtaatacgttttggacagtgattaccaaattttgtacttacagcatctcaataaaagctgccattctcgtattgatctgttcaatatctgcctgtgaataatctgtctcaaccactgtgtacgggattccttttttgtctttcactaatttcttgataagtgcggtttccacattatatgtatgacacgcctgaagaacaagatctacgacaccatctacctgaaaatcatcgatcagctcatccaaaagatccagacgattcttatttggagacatacaagaacatccaatgtttaaatattttcttgcgagtgcatcatatacatctggattctcttcatctaccattgctaacggtttcattccagtacagttttcaaaacatacgacaactccaccattatcctcaattgcacgaatgactttcaaggccgcaccgccagatggagatccggttacaaggatccttggttttttccctatattttttccttctgtatattctttttcaattttatctgttaccgcattgattctgtcttcaagaccttctgtgttaatgtcaaaaccacttccatatacagtattgatcacatctaatccattgactggtgcaggatcatttgccattacatattgaagacgtcttaatgctttattgattccatttcttaatttgatctgatgaagaactgcctcatctgtgatcgttgtctcaaatttatcttctagaactttcttgaaacgaagtaattctttcttatataactggattccatcttctgtctgacagtttggaagttctacgacatgaactggtttaaaatcagcaagcatttcgtacatttttttctttccatcgcatgttgtttctcctacaaccaaatctgaaaaatagaagaatggacatttatctgttttggcaaatccataacttgatttgatcaatggacataggtttcttggcagatctttttctgcatctgggattgtttcatctgatacggaacataatccgacaactgctgcacccatggcatttggaatctctcttggaagataggtacaaaatacaccgacaacaggtatttctttttctttaacctccttgatcgcgagaaaggaattctttctctgttctgcaaattcctcaaaaatctctggtaactctttctttaattcaaccattgtttgaatcctcctgtaagtaaaaattatcattttattttgcggatgcctaaaacggcagctccaattgctcctgtgtattgacataacggatctgttgctacttctttcactcctaaatgactggctaatgatcgtttgatcacatcaaattgtgctagtccaccagagaaaaatacttttggattcgctggcgccaatttctgtgcaaatgaagcggttcgctgacaaatagattctacacaaccaagaacaatatcaccaggtgcaatatcctgtgccaataatccaacgatttcactttctgcaaatacagcacacatactgttgatcttcgcaggtttggaatcttttacaaaagtgtcgattcttccaatctcactttcgactcgtttcatcgtcatctcaaggaatcgtccagttccagcagcacatttatcattcattaaaaaatctgtgacacatccaagatcgtcaatggtgatcactttgctatcctgcccaccgatatctatgatcgtgtcacaatctggattcataaaaaatgctccagctgcatggcaagtaatctccgtgatcttgaaatctgcctgatctaacagattccttccatatccagttgttacaataacatctatttctttatgttgtttttttatctctctgtaaagagcttctagagatttccttggactgatcgatgttgggatcatctttgtatctattatcttcatatcttctaacaaaacggcttttgtcatagacgaaccagaatctaatcctaaacttatcactgtacattgactccttttggaaagtttttcgggtaaattttatcatgaaaatggtgtggttgcaatgtaaaaaaacatgcttaaaaaaaagaactatacattttcattcaaatcctttataatagtatgctgtgaaaaatagcagtataaaactgctcatcatgcattaaaaaaaaggagacgaaagaaaaatgaatcaagagaaaaacaaaggtgcggaatacgacttttacgggaaacttccgctgcaaaaagcgattctccttggtctgcagcatgtattcgctatgttcgtaggtaaccttactccagtccttatcattacaggggcttgtggtattgcttctggaaccgaatttgcagacgttcagattgcgcttttacaaaatgcaatgttaattgccggaattgttacactgatccagttgtacgcgatcggaccgatcggtggaaaagttccaatcatcatgggaacgagttcaggatttatcggtgtctgcagcagtgttgcatctgttatgggtggtggaatccttggatatggtgcgatcatgggtgcttccattatcggtgggttatttgaatcagtattaggatttatgttaaaaccacttcgaagatttttcccagctgtcgtaactggtacggttgtactttccatcggattatcactgatcggtgttggtgtgaattcttttggtggaggaaattctgctaatgatttcggttcaatcgagaacttgttacttggaacaattgttcttgtgatcatcattgcattaaaacatggaacgaaaggtatcacaagtgcttcttctgtactgatcggaattatcgcaggatacattatcgcaggaatcatgggtgttgtacttcctacaactgctgtcaatgcagatggtgtagagtatacaaaagcatgggtgttaaactgggataaagttgctcaggctggatggtttgccattccaaaatttatgcctgtaaaaatcatttttgatgcaagagcgatcgtccctgtacttatcatgtttatcgtaactgctgtagaaacagtcggggatatttccggagttatcgaaggtggtatggatcgtgaagctacagattctgagctttctggtggtgttgtctgtgatggtatcggatctacgatcgcagcattctttggtgttttaccaaatacatcattcagccagaatgttggtcttgttactatgacaaagatcgtaaaccgttttgcacttgcaacaggagcaatcttcttaatcctgtgtggattatttccaaaacttgctgcattgatctctatcatgccacagagcgtattaggtggagcagctgttatgatgttctcttctatcgtaatcagtggtattcagctgatcacaaaagaaccattaacaatgagaaatattactgtcgtatctgtagctctcggacttggatatggaatcggtgcaaacagcacagttctttctggactacctgaaggaattcagttgatcttcggaggatctggtattgtacctgcggcacttgttgcaattatcttaaatattgcattgccaaaagaagattaaataaactaataaaaacagcactgcattgggaattttattcctgtacagtgctgtttttctatatgctttcctgcgtctattatcagctcataacaccaatttcatccggtacgatcacatcagcttctgtgcatgcaaggatatcttctacactatattcttctgcaagttcccttaacacgagaccatcttttgtaacttcaaaatagcagcgttctgttacgatatctgttacacaatgaactcccgtcaaaggaagtgtacatttctttaatatcttagactttccactcttttcacaatggtctgttgctacgatgatcttcttcactccggcacacagatccatggcaccacccattcctggcaccatcttccctggaatcgtccagttagcgatattgccttcttggtctacctgaagtgtaccaagaactgctgcatcaatatgtccgccacgtataaatgcaaaagacatctcatgatcatacacgcttccacctttgatcacagatgcaggctgtccgccagcatcaataacatcaatatctgcttcatcccagcttggggttggtccacttccgacggttccgatctctgcttccagccacagatccacaccttctgggagataatttacacacatcagcggaactccgataccaagatttacaaaatctccatctttaaaaaactttgcacatcgtgatgcgatcagctttcttcctgtcaatcctgccatatcactgacctccttccgcttttgctttggctcgctgccacattggacacattggtcgtttctcaccggttctttcatagatcatatcgatcacaggtgctggaacatcgatctcttctggtcctagttcacccacttccacgatctcttcgacttcaacgatcaccgtatcagcagccatagccatcgtactgtttgttgctctggaattcattcggaatgaaatattacctgcagtatctgctttcgttgctttgatcaaagcaacatctgcacgcaatggtaattccagaagatattctttgccatcgatcgttagtttttgtttaccttcttctacttctgtaccaagtcctgttggtgtcagacagcctcctaagcctgctccaccacaacggattctttctgcaaaggttccttgcggactaaattctatcgcaagttctcctgcaaacatctgatccttggcgatcgggttcaacccaatatgtgttgtgatcaaactcttaactctgtgatctttgatcagctttccgactccttgatctgccattccagcagatacagcgatcgcatcaatgtctttgattcctttttctaacattccatcaatgatctcatctgctgcaaattctccatgccagtctccaaacatgatcgtctgtccatcatgaattcttgagagcgcttcctctcttgttacaacttttgacttcaaaggcgtgacctcccttctatgttcatggtttgatcctggctttattctcctttgaattcagcctttctcttctccataaaagctttgactccttctataaaatcagaagatgccgcacattcacgctgtgtcggaatctcacattcatccaggtatttcttataatcagcaagccctgcctgataaatctgtttcttgatattcttataagaaagtaatggtccattagcaaatttcttagcaagtttcataacggtatcatctaattcctccgctggaactacatcatataccattccggcatcttttgcttcctgtgctttcattggtcttcctgtaacacacagttccattgctttctgaattccaagactcttaacaaacaggtacgttccgccggtatctggaactagtccaagattcacaaatgccataataaacttcgcattgtctgcgcatacaacaaagtcccctgaaaatgcaagacttactcctgcacctgctgccgctccacttacacttgagatcacaagcttactcatacgcttcagaccatcggttacattgccaactttactgatcagagaatccatattcacttctccaccttgttggatcaggttatagaagtatccaatgtctcctcctgctgaaaatgcctttggcattccttttaaaacaacaacttttacattcgggtcattctcacaagtatctactacgtacatcaactcgtctgccatctgatcatcaattgcattaagattcttcatatagttcattgtgatgataccaactccatcttctacaacgaactgcaatttctttagcttcataggcatatcctcctttaagttgttttgataactatattgtatcattttttgtacaatttgtgaagtttttcgacaaaattaaggggttgacgaatctcattttctatagtatcttatagccataaggtcatataactgacggagcacgtggaattaaccacatggaagtatgatcattaatcgccgaccgtctgggcaatctgtctggacgtgcggcgtttttttattctatttttacaacgctttatcgttcagatattaatcctgttaactttttacgtacttgtcctaagtacgtatcatccataaggaggaatactatgacagttggtcatgtccattccatcgaatcgatgggtctggttgatggaccagggatacgaaccgttatctttttacaaggatgtgctctaagatgtcgtttctgccataatcctgatacttgggaattatctggcgggaccgaatacacaccggaaaaacttgttgcaaagatccgacgatttaaaccttattttaaagaagatggtggtgttactttttctggtggagaacctttattacaacctgattttttaaaagagacattaaaactatgcaagaatgaaggcattcacacttgcatcgacactgcaggttatggactttctgattatgatgagattttaaatcatacagatcttgttcttcttgatctgaaacacatccataaaacggattatgagaaaatgacaggaagatcaatggatcgttttgaagaatttttgaatgctttaaaaaaacatcagactaagatatggattcgccatgtcgttgttccaggaattactgacagcgaagatcatatggctcagttaaaagcttatattcaaacgattcctaatgtagagaaagttgagctgcttccctatcatttacttggtaccaacaaatataaagttatggatattccttattctttagaaggtgtacctgccatggataaaaagaaaacagagatgttacaacaaacctattttgatcatgtttattttatggaggaaaaatcatgttaaacgaatggaatggattcaacgatggtgtctggacaaaagaaatcaatgtaagaaattttatacagaaaaactacactctctatgaaggagatgactctttcttagctgatgtatctcagaaaacaaaaaaagtctggaataaatgtgaagaactgcttgctgaagaattgaaaaaaggaggcgttttagatgttgagacagatatcatttctggtatcacgaacttcgcacctggatatattgataaagaaaatgaggtgattgttggacttcagacagatgcacccctaaaacgtattgtcaatctatatggcggtaaacgtatggcgcaccagtcattggaacaatatggttataaactaaatgaagagatcgaccgccattttaatgaatacagaaaaacacacaatgaaggggtttttgatgcctatccaaaacgtactcgtcttgcaagaactgctggacttctaacaggacttcctgatgcttatggacgtggacgtattattggagactaccgtcgtgttgctctttatggaatcgaccacttgatcgaagaaaaacaaaaagatctagactttgaagatggacctatgacagaagaccgcatccgtctgcgtgaagaaatttctgagcagatccgtgccctttctaaaatgaaagaaatggctgcatcttatggtgttgatatttcaaaacctgcaaaaaatgcgaaagaagctgttcaggcggtttatatgggatatcttgcgggaacaaaagaaaataatggagctgcaacttcccttggacgtacttctacattccttgatatttatattgaacgagatcttaaaaatggagtgatcacagaaatagaagctcaggaattgatcgatcaatttatcatcaaacttcgtctgacaagacatttaagaactcctgaatatgacgaactatttggtggggatcctacgtggatcacggagtctatcggtggagttggtattaatggaaaacctctggttactaagaactctttccgttatcttcatactttatataacattggaactgctccagagcctaacttaactgttttatggtctgaaaaactgccagacaactttaaacatttttgctctaaagtttctattgatacggattctatccaatatgaaaatgatgatgttatgcgcccagtctatggggatgattatgcgatcgcttgttgtgtatctgcaatgaaggttggaaaacagacacagctgttcggagcccgctgcaatctggcaaaatcactgctttatgcgatcaatggaggaattgacgagaaaaaaggaatccaggttgttcctggaatcgaaccgatcacagatgacgttcttgattttgacaaagtatgggaaaactataagaaagttatgacttatgttgctgaattatatgttgatacagtaaatatcattcattttatgcatgataaatacgcatatgaagccagccagtttgctcttcatgatacaaacttagagcgaatcgcagcttatggaattgctggtctgtctattgccgcagactctctatcagcgatcaaatatgcaactgtaaaaccaatccgcaatgaaaatggtgtagcaattgactttgaaaccattggtgatttccctaagtatggaaatgatgacgaccgcgcagatgatcttgcagttaacacagtaacattcttctctgacgaactaaagaaacatccaatttatagaaatgcgatccatactttatctgctttaacgatcacatccaatgttatgtatggtaagaaaaccggatccacaccagatggaagaaaactcggagaacctttagctccaggtgcaaacccaatgcatggacgagacgaaaatggtgctcttgcatccttaaactctgtcgctaaaattccatatcgcgatgtatgtcaggatggtgtatccaataccttttccatcgtaccagatgctcttggaaaagatcaggaacaacgagtacaaaaccttacaacaatcttagacggatactttgttcaaggtgcacatcatttgaatgtaaatgttatgcatagagaaactttgatcgatgctatggaacatccagaaaaatatccaacacttacgatccgtgtttctggatatgccgtgaactttaatcgattatcacgcgaacagcaggaagaagtgattcgtcgtacattccatcagagtatgtagatttttatgaaacagcaatggtgcctgattttttgatcgaatcaggcaccattactattcttcaaacatttctccctctatattacttatctgttcaatagggatgatcgtctgatctgtcataacaactgtgtgtttatatttatcaattttctttacacaaccagaacaggtaatatatgctcccccatctttcttagtatctggtacaaaatacgtgatctcaaccatttgttgtgtaccgatcgtttcagcgatcagatataaccttttatttaattctgctataacttcttcactcaacacctgttttgcatctgtttgtcttacagtttctttaatagctgcttcgtgtccggtaagtgccgcaaaaggcgaaaactgtgctgccctggcataaagtgacatacgagggtgcttctttgaagttggatgcggcagattgataatatcatcgtatttatgattgtactgatccttcataatcttcctccattgacactgaatacttactttctatgctttatgtccgccgatctgctcattacggtcttttgctgttgctccctcctgaaggttcattcctttcaagatagcgtttttcccaaacttctttttgattgtgagcattgtctgttgcatccgtttctcacgctctaaaacggcctcttcttcggcttgttcctgttcctttaccgtataatctgtaaaaagatcaagctgctcatacgtttcttcttcctttgaaaaactttcatccacgagcttgttcgctgtgatattgattcttctgatcagcagatttttatccacgatccgatcatataattccatcactgcatttgtgatcagcatggtagatgatgtcttccttttcaggtttgttgttccatgagcgtgttttggaactttccttccatatcggtcgatcgtaacagatcccttgtacttcctatatctatctggatccgttagattttctatatcataacctacagtcaatacgatctggtcagtaacaagtctcttatctaccagatcaagtgtcataagatcagtcatttcttttacaaccaactttgccttatcaaagtcatatgggcagtgaagtacttgcccggagcatacactgttggtttccggtttgtacgctttgacttgctccatagtacaaggctcatatccccaggcatgatcgatcagcagttccgcattgatcccaaacatcttataaagcagttcttcattatgaaattcatttggctttccgacggaacatcttgcaacatctcccattgagaaaagaccgtgttcttccaacttcttcgcatagcctttgcctactctccagaaatccgtaagcggtctgtgattccatagtttcctacggtaagacatttcgtctaattcggcgatccttacgccatccttatccggtttaatatgctttgctacgatatccatcgcaatcttgcacagatacatattcgttccgattccggcggttgctgtaattcccgttgtttttaaaacgtctcgtatcatagtcatggcaagttcccttgcagtcatctgataagtattcagataatctgttgcatctataaatacttcatcaattgagtacggaaaaatatcttctggcgcaatatacttcagataaatattataaatcttggaactatattccaaatagtattccatacgtggtggtgcaacaatataatcaaccttcaatgccggatttgcatttaattctgtgctgtcatccgacgaacctgtaaatgttctgtttaaagctttccacctgcgggtattattgacttctttaatcttttgcacgacttcaaacaaacgtggtctgcctggtattccatagcttttcagcgatggagataccgcaaggcagatcgtcttctccgtccggctttgatctgcaaccacaagatttgtcgttaaaggatcgcgatttcgctccttacattccacagaagcatagaatgatttgaggtcaatcgcaatataagcctttgtctttgtcatcgttctatgctcctctatttgcataatgaatcaaccatcatagcgaaccacatcatacaaaacataaataaaaaacacaatagtacagaaccacacccaacatttgatttcccatcatcggatgattccttcttcccttggctatgcttcgatgcatcatcttcttttaatttgttataaagataatattctctggcattgtctttccaatcttttttcccatttcgatcatagtcaaaaaaggccatattgatcactccccattccttaatctattcatgttttttctatttactagagcttggaaaatatgggcttaatactccagctacattactgattggcattgtttgcagccatactttcccagggcctgtaagtattgtgttaaacactccttctccaccaaacaacatattctttacacccggaacacttttgatctccatcgtacaacttgctgtcatcgcggccaaatgtccagtgtctacaacaatctgctctccagcctctaattcatattccacaacatgaccatcaaattctgcaaacatgataccatggccagatgctttctgcataataaaaccttctccgccaaataatccagctccgatctttttattaaagaatgcagataactcaactccattctcaccggcaagataagcacttttttgtaatatcatttcctgtccaggtgcaatttcaaatgccttgatggatcccgggaagcatgaagcaaaggcgatcatcccttctccgccttgtgctgtataaacattctggaacatcttttctcctgaaaacgctcttccaaagatctttcctattcccccattcgaagttgtttccattttcatatttggagacatccaagacattcctccaccttctgtaaccattttttctccagattccagataacagataactactggaagtgtttcacctaaaatttcatatctcataatgttttcctccttactcaacatttgatttgttattcttctttgcatttacaatataaattccaacacatacaagtgcgagtgcaatcagacttccgatattaaatgcctgtttgacttctcccaataccaatgccgacaagattacactgcataatggattcacaaatccgaagattgctacctttgacacgtcattatatgcaagtaatacagaccaaagtgtataggcaactgcagataccaatgcaagatacaacacgaccgtaattccaccaactgttacatgatctaaatgtccacccattgcgtttccgattaaaaataatacaattccaccaataaaaaactgagttccacttaatataactggtgatactttttttgaatagtaattgatcaatatcgtggatgttgcataggctaactgtgaaatcaaaacgaatccttctcccatcatcgtaaagccgaaatcaaaagaattcccaagaagattgatcacgacaactcctgcaaatcctaagatgcatcctgttaattttcttcccgttagtttttcatttcgtacgatcaaacatgacattaggatagcaataaaatttcctaaacctgtaatgattccacctttcactccagatgtatgtgccacgccgatataaaagaaaaaatactgtccaacagtctgtgcaaggcagacaggaactgcatattttagaatctttccatcaggcagtgtcactttcttttcctgtatagaagcaaaaatcaagacgaaaagtcctgctaacgcaaatcttattcctgcaaatacgatctgactggctgtgtttgtcgtatctacttgtaacagtcgatatcctgtcttgatcattggaatagcacttccccatagaatacagcataaacttgccagcgctgctacaacccaagtctttgttaatgtatgatgctctgtcttcattatcttcttatttgtcctctcttgtatagtactttatttgtattaattctatcatattttcatatcttatccaatccatacattattgatatttttgtaatgataacaaaagactcagaagtccacggctcctgagtcctttaacataattatcatatatctattgcattactgcattccgtttgccgtcttatatttatacagcatttcggcatgattttgttcttctacctgaatgtcagccatcaactttctaagatcactgtcaccaaacataaatacatttgtattatactctccggaaaccaatttctctgttccaattgcatcagttgcaagaaatgcatcatgcatcttatcttcggactggctcgctgctgtatagattgctcttggttcatagtctcttccatcactgtcattgcagtcacttgacggtactgttccatctaagacctgtgtgagtgaatcgtaatgtgtctgctcttttttgtgtaactgttcaaaaagatttttaagttctggatcgatcgcctgctgtgcgtatttttgatacttttctatgcagcttttctcctgtgttcttaggttttcaattgctgttctttctgtctcttttaataccatgatatgagttcctttctactttggaaatttttatgatggtattatctgctgtttgatgcatttctatgcaacgaatggcgaaaatttaacattcaattacattgaaattccatcgtaccatccgtctgtaattctgcttgatcggataagtaaaattccaaagtcataatatttttttcattcaattccagttttttcacttgatactttaccatttcactcacagaaaatttaccatcttctttatagatcgttgtcaaaattccttctgtctttccattgttgctttgtaatcggatatttgcaaatcctccggaactattttgctgtaacaatgttatcgttgttggttttccagcttttgttttttcataaaatgttttcaatttctcaccatgacttgtcttggatggtttgaattttactggtgcattttttgtactatgtttttcttccccgatctgggcaacaggataacctttggatgttaatgtatcatatagtgtttgtaagtctttttttgtaactttattctcattgatttttatgttttgacaaatgtctgaaatttgcttaacttctttttgtgcctgagctttttctcgctttgttatcaccaatggttcccacttttttgtcttatgatctgtttgttttgttgtttcttttatatttgatgatctacatgctgtaagtgttatgacacttgcgagtaacaaaatagctagcattaatttactacatatattcttctgatattttctttgcttttctgaccacatattcttctgcccttttaaaatccttatgaataatcccatatttcatacccctgtcgatttgttttactttgattcctgtatattttgaggcttccttacaaatctcttcggatacgtcaatcgccgttacgttatagtttcgctttagaaaatattttgtatcgcgtccggaaccgcacccaaaatctaagatggatgcgcccgatggaagataagataaaaatttattttgtatgtttgtaaaatctacggatcttgttgtttgtatgaatgatttagtgtatttgttataataatttatggttttgttgttcattggaatcctcgcttaagtacattctaataaccatttgacagctttcgctaatctcttttggacatcagcaaaatgcccgccgctgttaaattctaatgttgtttgctttaccttaggatcattgcgcaaaattcgttcctgtgttctagttcgatctccaactcttgccatgaccggattctttgttttttcttcttttcctccaaggcttaagtagatattgctttcatgctttatttgatgatgtaacacatattcatcccattgttcaaaccataaagaaccggagcagcttgcaattgctgagaagatatccgtttcatatgctgtccataaagcaaacaatcctgcaagggaatatccgatcagataaatttctctatctaccccgtaatctgcttttaatttcggaatcaaatcattcattaaccattgtaaagtctttggaccatttcctttgaaatcatcatctccgaaggcagcaggtgacttccatggagaaaaatcaccattccaatcttttacctgaaatgcacagaaaagaaaatcctgatcattgactgtctccatcagacaatcccacatatgtgctatttcatttccacgatgagggtacattccccataaaatgatcggaccgccggaaccattttgctctatataacatgctttctgttttatctgtaatttctgcataaatacattcatctccataagtttttctgcttttaatggatttattttcatgaattttggcttattccctagttgtagaatcctccagttcttctaacgcgtccatataattatccatccattccatctgccattgtctgggatctgtttctgatatctggcttaacggatcgatttcgtcaaacattccaagattctctgccatatctagcggaaacaaagtttcatctggaccgattattacctgatctccaatccctagattcctgtcataagctgttaattcttccattgaaatctcttctggttcatccacggcatcttcttttacataaaaagttaacattggaatttctgcatcttctgcttctatttgtacgatcgtataaattggtattttattcattgtttgtaattccatcatatcacaatccccttgcaatgatcaatttcatgctgtatgatctgtgctgttcatccaaaatattttccatgctgttctgtgacatgctcccaccacttaaatccctgattttgaagtgggggcttcttgctcaatggctctactgagccaagtatctacaagctatcctcgcgtgccccgcgattcttttgcccggacacgggcatgttttcttattatccaattgtccggatacggacagtttatgctgtcaacatccttcttgcctcttcacggatgttgatcgctgcattgcaatctctgtccatctcatttccacactcacagtgatacactctttcggataatttcagttctttctttatccttccacatttacagcattttttactggaaggaaagaaacggtctacctttatcattctctttccctgccacgccagtttatagtctaacattttcctgaacagtccatatccattatcatgtacgctttttccgaagtgcagacactgactcattgctttcatatcgatatcttccaccgcaactgcatcataactgtctgcgatcttccggctgagtttgtgcagatgatctcttcgcttatttcgtatcttttcatgacatcgggcaactttctttttctgcagttcatagttatggcttccccgtacacatcttgacaactttcgctgctctctcgccagtcttttttcattttttctgaaaaaacctgcttcttccttctcgatcttttctgaaaacactgccatcccctgcattgcataatctatcccaagtatctttgcagtactatagtctggttcagctgcttggttttcacagctgtatccttcatacagcagacttgcaaagtattttccggatggttccatactgacagtcactgatttcaagcgaagtccttctgctggctccctgtgttttttcatggcgatccattttaatttcggaagtcggatccgcttgctttccaccaggatatttccattgaccacattcgttgtataactgtttctagaatgatgttttgacttgaatcttggaaatccagtcttgggatcccgaaaaaaattcttatatgccttttccagatgaagctggacatttgccagtgccagcgaatctacttctttcagaaatggatactcccttttatacatggccggtgtgttctttaacattttctttgtcttttcatattctcgaatcttatcatcaagcatctgattgtacagaaaacgacaacaaccaaatgttttgccaagaagtatcttctgttcttctgtcggatagatccggaaacgatatgctatgttcaatactttttctctccctgggtttcaatgtattgacggatcacttctactggagtgcctgctaccggcacttttataagcattgataaatttactaaattctgtcctcggctgcgcacggaatattacatgcacatgatcaatgtcatgattctattataccatagatcgcactatcgaacaagtgttctttcactttttcgcaattcatcttccacctgcagaggaaggagaattcttgctatattatgttaaaatcctgatccagataatctacttctatctccttatatctcttacaaggtctcactccatccaaagataaacatccttccgctgtctcaaatacgcctgatttctttgtgatcttcggattgatcattgcaaactgaaatggcccaactgctactacgataatgttctttttaacgccgatcatatttgctgccattccaacacaatgatccaaattagctcttagggtatctaacaaatcaactactacctgttgatctgcttttgttgcatctgttgatttctgtgctagaaacagtggatctttcattatgtcttttatcattttatttttaactcctttatttcctttataaattcttctgtagaaatatataaattttctaatattggtatcaaatccatgttccctgagtcttttagaaaatatatttttaaatccaattgcagtctccacccgtgatagcaaggcttagtaaagcatccatcttttcgacttcttcttcaccctcgattttctgaagtaactgcgcagtatctaaaatatcttccatattttcatctggtccaatctcatagtcaatctctgcctcacagtctggacatggaatcttctccatcgtctgtaatgagaggaatctattcccacattttttgcattcataatatccgcatttttttgttccatctggtacataatacattgttcgtatctccttttttgctttattatctcatattatacatctaatctggtctgttgtcttagtttttttgttaccgctatatttgttttttatcctttgtcatatcacaatccctttccaatcttattgccagcagttggtttggcaattggatttattttacaaaatatttttcttaaatcatcacatactaagaaacgaggaggtttcaatgcatgaatgataagaaaaagaaacgagaacttacgaacgaagaaattgatgaaaatatcttcgaaatgtgcaatatttgttctaccacagattgtactggattgattcaggttgttccaagaacagaagccgagcttgaatcttacgaagaattgtatcccttccgaccaccgtttttacctcgtgatgatgattaagtcgtcatccattttctcctgtgacaagatcttatggcctgttatgactataaggtcttgtttgatcttttcacctttgaatctatctacttatctcaaatacattcttctcctcagcctctacaatctcacctgtcttctgtgcatattttaatcctcgctctactgctgatataagcacattactgattcgagcatatcccatcgttcggattgtcgcttttattaagtcttcctttttcattctgcctttttcaaggagtgtcatacaaactgcattctttaattcctgctgacaaatatcatttactgatcttctgatattagcattcttatcttctctgaaactgtaataagcagacggatcttgatctttgcgccaataaaattttactccctgctgtttgttcatttgggtatttgcaatctttaacgccttttgcgttgcttctaatgtctttgggcttgatcttgcaatattgaaagatcgtaatgttttctttaccaaagtatcataagaaactggtgcctctgtatcaatgatctgttgtattttttcagtgatcattttcttatttttactttgtacatattcatctgtagatatatctgtcattatcaaatccgcagatatgtatgattctttatgatacaatgactccacatcctggtttggctttgtaagattcatattagattttataacatgatcttgtcctgcaaaatgctttgttatcttaggttcttggacaggaatatcctttattttttgcgtatcttgtatcttcataggcagagtaccacgtccataggagttgctgtaccgcatgggcgtgggtgaatgcccataacctaccgtttgccttgattttgaatatactgttttactactttcagactgttttcgctaacggtcgtgataaaataactgtctgaccagaaataaggtttccaataatacttctttaaaagtgtttcgccataaagtttccttgcccgccttgctgtctgtgtctttaaaacatttgccaactctgcaagagaagttattgcatccacttccatgaggatatggatatgatctggctcaccattaatctccaggatacggaatccacgctgttcggcaatgtagtggatacgttcataaacagtatccttcacgtccctggtaagtaccggatgcctgtattttgtgacaagcacaatatgatactataacaaaaagcaactgtgtctgtgcacataataatctgtattttctttcttcctcataacggttcttctttacacccaaatatatgtttggtataattatattataaaatacaatgtattgcaatgcattagaaaggagacagccaatggcttattctgtagcacaacgtgtcatttcaaaaaaagacagcatttacgattattgtgatgatctcagcagaaaatcaaagctgctgtataacgcttccctctttcgtatccggaatatttttaccggatatgaaaaagaacatctcacttccaacgaagccgaagtattcggggaagtaaaattgctgcatgaatcttatccgggcatccatgtccaaaaagtaatatgctacaagcatctggagaagctgatgcgcgtgacagagaatcctgatttctttgccggactccctatgcagacagcccaggcgatcgtgaaacaggcagtcacagatttcaacaactggctgaaatcattgaaggcttatgcgaaacatccagaggattttcttggcagaccgaagatgccacattacaaaaaggacagccttactactgtcacggtcacaaaccaggatgctgttttatatccagaagagtccggggtctccttaaaactaccgctcatcaaggagcgtattctgttatctaacatttccggcaggtctacgctgaaggagattaagatcaaaccatattatgggcgcttccttctttgtctgactatggaagaaccagatataacagaaacactttcgatgccccatgtctgcgccattgattttggtacggataacttcgcagccatcgtatgtgatgatcattcatcagctatttacaaaggcggagctgtcttatccaatacccaatggtttcataaacagcgggcaaagtacatttccatcattacaaaaggtcatagtcagatgaatgcaacttctgcaagattgaaagatctttcttttcatcatgcgaattttaccaaagaccagtgccataagattagccgaaacattatcgacttctgtctggagcatcaggctgggactttaatccttggagtaaatccactttggaagcagcgcaccaacatgggtactgcaagcaatcagaagtttgtagctatgccgatcagcatcctgcgtaccatgatctcctataaggcattgaacgcaggtatccgcatcatcgagcaggaagaaagctatacatcaaaagcggatatcaccatgaatgattatcttcctacttacggaaaagacgacaataacgcaactttttccggtgcacgtattacacgtgggctttatcgttgtgcggatgggacgctcttgaatgcagactgcaatgcagccgcaaacattatgaggaaagcaatccctgatatctggaaggataccagtgattatacattcctttcatccccaaaagtgtatggattccacgaactgaaccctaaaagtattcctgtcaaaaggatagtggcataaatgaatatgccttaattggtacggacagccagattttttggtcagaaatgggtaactgtcacgactgttagaaagcacttccataggagccattgcaccgcatgggaggggtaattcatgtccgaggtattttttatacaaatgtcgtgaatgattggaaatccgttgtagatcaccgcatagtttaatactttgtcgatcttatatgtcagttgtattttggcatcttccatagtgtatactcccgttattttttcatttaactttttctttctatttactaatcttactaatcgtccaatactcactatttccaccgaatttcttgaaaaatagaatattcatgctaaaataaataattgaattaagaaatcattataaatgaaacaatcgtcaaagaaggtagtattatgaaatcaaaacttaaaaatttttccttacttacaatcagcacactcattatggctgtcggaatttacttctttaaatttgcaaacaatttcacatttggtggtatcacaggtattgccgttttagttacaaaattccttcctatttcttccagtgatttttcttttgttgtgaatattttattgctaatcattggatggatcgtcttaggtaaaagctttgctgaaaaaacagcttacagcacgattcttttatctgtaagtttatctcttttagagcgaatttatcctatgagtcatccactaaccaatgagccattattagagttgatatttgcaatcttattgccagcgcttggttcagcaatcttatttaatattggagcttctagtggtggtacagatgttatcgccatgattcttaaaaaatatacgaatgtagatatcggaaagggcttaatgatctctgatcttatctttactctcgcaggattcctagtgtttaacgtcaaaacaggactttattctttgcttggtctgattatgcgttctgcgttgatcgataactttattgaaagttttaaccgttctaaatattttcatgttgtaacttccaatgcaacatgtatttgtgattttatccaaaatgatctacagcgcggagcaaccattgtaaatgcgaccggagcctttacaggggatgataaatatattatcctgacggttcttagtccttcacaagcagtgaaactttatcaaagaacatgatccaaaagcttttcttttaatttctaatacaagtgagattatcggaaaaggcttccattctgtttaagatggacagccttttctctgctttcatctggtacataatacattgttcctatctccttttttgcttttattggatttattttacaaaatatttttcttaaatcatcacatactaagaaacgaggaggtttcaatgtatgactataaggtcttgtatatgatagcataaataaccatataagagaagttccttcattcttgcaagtcctaatgtcggtacactattatattttatctgcatttgctactttgcagagcaacatatcaattattattttcgcaaaatatgagtcatctataaagttgtaaagtggtgtataaaatggataaactggtttattcaaaagtgaaatgatcaaagtttgttaaagaaaatcttcaaaaaaataaagattattatagaaagatttcctgcatgatgatataattcaagcgtattagtgccttgattcgtttgataaatatatagataatttaattattgcaacagatgctgatatggatgttgatgatttgctacaagaagaatttttctagaacacaacgatgtttatagagatatgcctcatagtacaattataaatacaaacttcattatatctaccgggaattcctgatagatttctttcgcatggatctaaattctctcccgaagaacgcttcttctttgagattttccaaacacaatcaacatgtcatgtctctctgtcttacttatcgtgtcaaccttggactctctctaaggaaaacctgcatggctcttaaagatatccatggcatctccatctctcatcagcaggtcgctaattactgcaagacggcttttctctgtgtcaagcctttcgttgacaactacgattacaagactggaaaagtctttactgccgatgaaacttacatcaagatccgtggtctaaaatcctatatctggtttatcatggatgctgccaagcgttccatcatcggctaccaggtctctgacaatcgcggcgttggtccctgtatccttgccatgcggatggctttttcaaaacttaaggaacttcctaagaactttaagttcatcgctgatgcttacagtgcttatcctcttgctgcccagcagttttttcacgaatatggtgataagttccacttcgagatcacccaggtcgttggattaactaatatcaatgctgtatccaaagcctttcgtccttataagcagatcgttgaacggctcaaccgcacttacaaagcttcttaccgcaagaccaatggctttgacaacatcaatggtgccaactatgatctcgcgttatgggttgcttattacaacttcttaagacctcataaacataataactataaagtcctgaatcacattgatatgctttcaaatgctgataatatgccaggcaaatggcaactcctcatctttcttggtcagcaaacgattaaacaatttcaggaatctgaacattaactattcttagattctaaaccagaggttacataccagtcactgcgtgagcagcctgcccttgatagcacaaaaaagaactgctatactgctgtgaacaacgggaaatcgaactgttcttgagttctttaccgtcggtgatctatacccagcagttctttttcgtgctatcaagggtgatgtcaacttttcattgactaaaaatatctgcaattttcaaggtccattaagtccttttcttggactttgttttttcatagattatttgacacccgcacatatttgtttccttgtcaagtatttgttacaaaataaaaagaccccagtattatttctaatactgagatcttaatgcatcatcttaacttaatgacattgctttattgcgaccacctttttattatcgtaagatataatactatgtatatgttagaatacagggccaaaatcaatatcttcatcatcattgttttcactcttttttccactcatgtcagcaatcaattcatccatggaaatacgataatcttcgtaatgcgtatttgttgattttataaagcgattatgaagaaacaccaagcctcccagcatgtatcgctcgaaagttgctacatttttagggtactccggatccgcttctgaatatcggaatgcattattgacacgatcaactgcggaaagttcatctctatctgcatttaacataacaagttggtatgcaaattttaaatcattataatgatttgaaaactgagatgccatgattcttttagaatctcctgtattatctggattagctgtcaactgataatgtgccccaacaatagctgctgtcaaataaagttcaaccgcagaattgaatattgtagcgccactgtgtggatcaatttctgtcgtgagatcattgaccattgctacgtattttcctctaaaaagataatcatctgaaaaaattctttttaccttagccattgttatctcacctccttaatttcagtcgcatactgaccagttttttccattgtgtattctttaccaataatatctttaatagcttccttaacataattgccatctgtatctttaataaaaaagattacttgctctgcgatattaggcattacacggcagaagctctcaatacgatcagtatcgaaagatgatgatggagcatccataacaagtgggtatggttctacatccagaatattagcaagttcctcgtcatcagatttattctgagcatctgatacgactttttctctagcgagtttaataattcctccgataaaagcaaatgctaagattgcatcctgtgatgttgaattttgaaaatcgataagatctgaatgtttattactacgtaatttcatgttatagtttgcgtcaagttccatcataatattgacatcaaatacctcattgaagatttcatttatagcattctgaagctgttccttcttttctttttccttacgctcacaaaattgtttgatgcgctcatagacctttgtcgcttgtttctcatactcagtaagctttaatacacgctcatcttttgaacgatatccctctttctctttttctgcagatgctttagtgttttcgtttactcgaataagttcttctctacgtgcaatttcctttcctgtatgaaaaatgtcgttttccaatttccgttcgcgttctttcttcttcgccatatccggatagcttttgatttcttcatcaatctccgatttgcgttttttatcacttacaacagaattttccgcatttgcaattgtctcaatgtctgcacgatgttttttcaaaaattcatcgccaccttggattcttacagttgctgtactttcaaagcttttgatgctttctccaagattattgggaggtaaatatttaattaactgttcaagacgtaacttgcatttttccgaaagactatttacatcctgtccacaaaaacattctccttctttaaaatatccatctaaaacataacgaatagcacgagcttccatcccagggactcctttacttgcatcgtcattattttcttttaaaaattccaacgtgtctttaattaagtcttgggctagaatacgatatccatattcgctaaaatccgagaataccccttttcgctttgcttctatatctttttcggcacgttcaatagcaactcctaatcgaattgtttcacgttgtttatcagcaacgtcgccacttttgatgatttcgtcgcttacttcttccttagaacgtttcaattcttcaagagaagattcaagtgtagtcttttcatctgtatatttctcaatattagctactgctgtattgatttttgtttgaagctcctgagtctttttgtccgttgagtttgctgcaatttcattctgataatcgcggataaccgcctttagatcggtctgttcattataaagccagttaaagccgagcattccacgaatagcttttacgaacttactatttcccgatgacttgcctgatgaaatttcctgtccaattgcttcgatattctcaccttggaaaaagaagtaagggaaaagatctttcgggacaatttctgttacaagtgatgtagcatcataatcaaggagttctttgctatttccatcttcatcagtatatgtaatcttaagaaaagactctcctactctaacctgtacattaaatttttgtgccatcgcataacgatcaataacataatcccttccaaggtgttcaagaacgataattccttcaatttttctctgttcactcggcagcatatcatttttcatatctacattgatgatactcttaatccccgttgcctctccataaaaaatccaagaaaaagactggagcaatgttgtttttccggttgcatttttagcaatcaatagagttgctttcttatcaggatctgtcgagaagataatcttttgtccatgtccatcttcatcatccataaattgcctgaaattgtgtaattccagtgatttaataatcatgctttagccacctcctcttcaataattttcttaattcgcttttgcatttctggcccgttatactttttctttttataattaactcgctccaaatttgttatacgtttagtaagcgtatcataaagcgctttttcttcttcttgcgttctattataattgatatctgccattagtcgtcatctccccactctatatttggctcatagttttcaaattcatacaaaccataatcatttttaatctgctctaccaatgtgtcgcttttacctctatttaatgaatgagctccaaattcttccattcgtgtggtttcattcttaacaaggctcttatatatttttaccgattcttctgttccttcaagctcgtccgctggaatcggaagcgtcacaaaatcataaataattgctctatcttttccaggtgccaaacgtaagatacggcctcgtctttggatatattcacgtggattcgtactactcgccagaatgaatgccgtacgaatacctggaatatttacaccctcatccaagcacttaattgcaactaatgcttgaagattattcccatctttgaaacgattacgaattacacgtcgttcttcaacgtcttcttgtgaagtataacgactgatcttcattcccatttcaataccaagcatgcgtgttacttcatcaatctgtctactttcctcttctgagccattatctactttggccgttccacaatagactaacatgtagtattcatcggtatgttttttcatttctgaacgaagtgctgcgagtttcgcatttgcacctgcgactattcttgccctttttaatacaagcattttcccttgttgatctatcgaaccgtccttttttatatgcttgatcagttttctgctaagctccatatactcagcgcgttcttctgaatctaaatacaccacaatcggatgatactcatactgtgtaagcttcaaatcatccattgcattttccaatgtgtatgaaatgcatttattaccgaaataattaaaaatacggtctgttccttcttgatctccatggcgctcaattgttgctgataatgctaaacgataatcaaacgtatcaatgagacacggggccatattaggacttccaaaattatgtgcttcatctgctacaataagggcacgtccttcgatcttttgcaaagcctcttgtacttttggaagcttgtaagaagcattggtggtaataaagaagaagaacgggagtgttcctgcattataggcaagaatgctactttttaattctatcatataattcgcatatttagggtttgaatatccaacaatcatatgattaatgtggaatttgggggcatcttccatccactgctcaactaggtgttgatacggagcaactataacaactgccaggtggtatttgcaacgctcaagaagtgtagtcatggccccataagctgtaagtgtctttccagcgcccgttgccatatcaaaaattccgatgcatctatttgcaaaccacttattaatagcttctccttggtattcatacggaaatgtaggcaataaagctttgtcaatccttggaagatcaatacttgctctatttttaaagtcttcttcatccttttcgatatttcgattaaacgtttcacgttcatattggaacaatttatctttaacagcagctggaaattcgtaaatttcaatattattggtcatgttggcccagagctcatcaaaatcattttctatttcggccgcatacgttcttgattcttcccaagttttatatatcgtaattgattcgaaattctgagagaaggcatttgctgactcatttaacgaaccatcaaaagcaatcatgtttccatgagaatcggtcatcaccccaattttctcatgatacattcccatatcagattcggaatattccgttacagcaaccttaatctccattgctccggatgcgattaaatggcaaagtatattcaacctttcttttccaaaatcgtcttccggttgtttcatttctgcaagcattgatgattcaataacttctcgctttgttttatagccctgtcggatagcttcaatatcttcttttgttaatctcggtgacacgatgaatttaataacggattcctctgtagcgggatcataatgatccgccacctgtaagagtcctctggaagtgtagattaacgatgaagacgagaaaaagcccactgcacgcttatatgaaacactatgttttaatactttttcaataaaatcgcggccgatatttgaagtatctgcggagcgatatctatttttaatattcagatccttaaattccataagatttccctcctagttacatactttcttcgatatcatctagcgccgcaataagctcttcgaagtcttcttctgtagtaaaataactaatactaaacctaatcgttccagcaggataagtacccatatactgatgtgcaatcggagcacattctagtccggtacgtacagaaatgccacgttcattgaatatatttccagcagagtcactgctaataccatccatcaaacacgaaacaatacctacatatggaatactgtgactagctccaatcgtatgaatgaaatcataattattaagaatttcaagaagcctctttctatgttcttgttctactttccaaatattatcaacaccagtttttaaaagccattcaagcgcagcatgtaacccggcaataccagcaatattcaatgttccacattcatatttctgtggaagagattccggcatatcttgattagcagaatcaaatccagttccaccaaacaatactgccggaaaatctgctgctggattcattacaaatccagaaataccagtaggcccatacaacgttttatggccagcaaatactgcataatcaaacgtttcaaggccaacattaacgtctataagaccagcggtctgagacatgtcagccagcgtgcgtgcattatattcttttgctatagcaaaaatctgttcaattggagcaatgaccccaaacgcattacttgcatgcgagacaatgactaaatcaggctttgtttcatcaaactgatatcgaattttgtccatattatatgttaaattattgcaatccatcgacaactggatgacatttatgtcaccccttttttcaaaatggtgcagggttcgtgttacagcattatgctcaaacggcgaaatataaatgttcttagctccacataggatacttccctgaataatcatattcaaggaaattgttgctgtgggttcaaaaataacttgcttaaccggacaatgtaataatgtccgaaccatagtcctggtatcgtcaatcaacttaccagccgactcagcctgcttgtaatgtccacgtccagcatttccaccacttcttctataaaaaccatccataaagtcatagacacattccggttttggaaatgtagttgccgcattatcaaaatatgccattttctacaactcctctcaacataattttttaagaatttccattaaaatctggcgtttttcttgctcggaaatagcttgacccatggaatcaatttgagaaataatcgagttataaagaagtttacctctcttgctctcttctaccttttcaaatctttttcttacagcttttccatctgcggtctggtatgtaagttcatacccctctgtctttgcttcttttcctacaacttcttctgtgtgatggaatgattcagcggtctctctatactgtttcatgtttctttcaaacataataacaacatcctcatcccagtcctcaatacgaagatctgtggccattttagcgaccttggtaataaaggaatcttcatcatttgtaacagctttaaataccgttaaacatctttcagttccatccgtaaataactgttcaaacacagcttcatcaagtttttcacaccaatcacgaataatagatgaaagagacatcttcttacactcagatgcgtcaagagtacagaataattctcgcatcatctttacgagttcaccctttaaatagccaagagccccgtcgtaatgttcttttgtggtataaatcttgtcagcaagggttttatcaactttgtcaactccataaattttgggaagaacacggaatacgaggtcataacttcctgcgtttttacgcatctcttgaagaaatgcgcggtcttccttgttgatttttttcccgttgatagtctttgtattttttgaatatttcggtagatccatgtaccaacgtttcattgatgccattacacgttcatatggtgctacatttgcatcttcaacgccatattctccaaacatatcttcaagagatgaaatatatacttctttgtccgaattccaatcgatataagccaacgtaaacatttctggttcagcattaagctgttccattgtatcggcattcataggaacctgcccgaaacggtcactaattacaacttcttttttatattcatgtaacacagcggcaagatagattggaataagcccttttctcatgccaatatgcatctctgagccagaaagctctttgtatagttgagcaaaacttaaactgtctgcctttctggaatttgttacaaaagactccataactttaagtgccccagcaagcagattattattaggtttcaaattgatgtggattccgttggtatctgctgcttcaagaactcctgtgttaatgagtgtacttctcataattgagacttcctgtccagtaccgctaagcccaagattcggctcaagctcggtacgaaggataccagcaatcaattttgctctactattcctagttaccgtagtaatttcttctttattgattacttcattgttaattacaggagttaatccatagatgttatcacaaatatctgaaagcaggtttgtaagatcagattttcttgctactttttttacatctccattaaaaatgtatgtagagcaatgtttttctggtcttgtatatccacttataaatcctctcaatacatctctcatatcttcatagactacttcatagtcttcaaagagaatcggatcatcagacacagtctgcatcagagcttctacagcgtcaaattctgcaacagaatcacgaatgtcggtatacttatccggaagaacaaaaacacagtctaaacagttctcagaagcctttttaagagtttttttaaggttagtgatatttgtctcagcattaggaacaactgcaaaaataacgccatctgcattgatatcctcgcgtttcaatacccagttggtatcctcacgcacttcagaaacatctataaatcggaaatcaaaatatctcgtcatttctttctcgtcgttataacgagaaggatataagtaatgatcaaagtttgattcattaagtacgtttttaatatcgagtttcggagcccgcttgccaatcatgttgataatttctgtatgtacatcaacccctgaagtctccttcaaacggagataattattgctcctttttagatacactacatatttatcctctacaagacgtttaacagcatcgtttacagcatctgttccataatagctgtaaatacctgtcaactcatcaagagtcggtttaagcttctcaaaatgctccagaatataaatcagtgtaagcgttttaacaatctttgcttcaagactattgtcatcaatctttctaagaattgatgaagtaagcacataatatttatgaaggtttccagcgtatacttcctgttttagcagtggttcgaaataatcataaattaaatctggcgttgcgagagcaaatgcttcatccgcatgttggctgaggaaagaagataatgttgaatcaccttttgctgaaataaatgtgaacaatgttctttcattctgcgccacacgttcagaaagtcgcgggagaacaaacgttgacactggatgcaatgggtagcaatcataaataaccttgtcaattccttcttcataaaaatcagagaacagtggatgctgctcataaagtgtcttcattgcttcgaatgaagtagagtattcttttttgaatttgttccattttttctcatttttttcaatcgctgcggcaataatctcatatgtctgtgtaaaattattgttgagatagatatgacggaatctttcggatacccctctccaaccatcgaccatagcctttgatgctctttcaatataacttgtaatttccttgtgtgaaatgagcatcagatgaagttgcgattttccagagcgtccgcatttttctgcaaagtcctgaagcatctttgtatcgctctttgttgcatcagaaatgtgattctcaaggtatttgctaaattcatcataaattacgtagatgcctgtatatcccttaggtttaagtgctttaacaacttcttcatagagttcagcaacgtcaaaacctacaaaagggttaaagtggctaccagctgtcagtgaaggataaagtttctcgaattctgcatatgcggaagggtcaaaatcatgaagacgttcaataaatttatttgcttgaccgtcaatcaatgttttaaaacaattatatgtctctggaaaattgctcttccatttaacgatcgtgttaatagctgcctgatagttagtctccggcataatgtctgtcaattcgttttcagcaagagttctctccaatgcgagtaaaaaagcttgagcaagagaattgctgcttccagagataacaactggaagaattttattactaccatgataataattctgaatcaactgatagagttcaggtttttccgaactaataacaggcatcattttctcaaagagttctggatcttttttcataaggattgaaagaatcataagaacaatatgactctttccctttccataagccccaatcagaattctggccctatctgtagaattctgagacgtgctaagtagaacatcttcaagtaatgacaacgctgattttgttggaatatagtttttaagctttccgtcatcattcatgtcgtatgcaatgttgactgaactttgaaatccagtagctactgaaatcatatttgtcatgctttactctcttcctttctcgatattctcgtaatatttttctacacactcattaaacgtgtaagacttatcaatgcgtacaacatcaagaccagctgtacgaataattttaactgcaccagttttttcggcctcacggagcgcatcaatcatggtaatagtatccagattaaatactttcccaatatttttcggtgctgtaagaagctcattaagacctacttctgtagctcctgctgcttggtccatcaagacagctaaaataacccacggatcaatactttctgccgatggagaaacttttctgtagacctttctatttttgtcgacgatgtcaaccagtccaagttctccaaatggacaatcgatattgttttctggtgatacctttcctggatctgttttgtatctgggaacatatgtcccaatgatgcaattaaaatcatctgtaagcgaacgcattgctgcgcttttgccgtttgcatcaattacgtagccgtttaatccagcaacaaaatcatttctgttaaactcagtcatattgaatacgttgtagaaataataccatgatgctgccagttcttcttgtgaagccaatcgatactgtaatagatacaatgtaccaagttcttcaatgtacctatcatgttcgtaaatcttctctccgagcggagtaaatgtttgcactcttttcccgaagttcggttcttccgtgataccaactgcttgcagccaatatctcagagatttaaccatatttgagccaattcctaacgtatccatcggatttttttccttagaaataaacgctgttggttcgttttttactgctttcatgcctttgctcagccatctttttctgataaagaacgtctcatgagcacgaaacttcattgccatataatcatcctccagttatcactcttttgttcttaagtatttatccatcatgcaaccaccgcaaagaatcttttgatccacacacatgccgcagtgaacacatttgtctgggttaatgtaataataatcacctacaattgaaatagcaccagctttacaaactgattcgcacttcaggcatttatggcaggcgttaaacttgcgcacctgatagcccgctttacgttgcaaattttcatgattcgcaacattcattgtacgtattttcactgcataatcataaccatcctggttgaatggttgaatcgaaataattggtacattcgtcctagtatccaatataatcacttcatgaaggagctttcttcccatttcaggcgcaagttttccaaaaggaacaaacatgcctaccagttcatcatcaaacgggcgtgacaatttgtaaattttagcatgttcttcagatgtacagttagtaaatcgaatctttacatcctttgcagccggaagtccgttaccaccttgacgagctttccatgctccactatcaatgtattcttcgggatcaggcttcccaatcttttttgcaaatccaatcagaaaatccctccactccttagcacgttctggcatatagatgtttgtaaggaaaatatctctattgttattattcggacacagccaacatccaacacgctcatagccataacgataagcatcgttaaaatcaatccccgtagttagaatatataaccagatatcaatatccatccaaaagaaaattggcgaagcaaccgtttgtttgttaatcttcacagattctgaactatcttctacacgattatacttactacgagacacggattctgccttacggatgccataaaaagttaaaacctgttgatttctatacatgttatttaacactcttgtaattggacctgttttaaacattgaacaacaccaacgcatcatacgggctggtggaccaatcgtatcagccatgttgagaaaattttgttcgttattttttgcaatttgaaaaattgcacgcggatgctccttgcggaatctttctgcataatcaattgtagtcggaaactccaatgttgtatttccgaaaatgtgtaccaaacttggatctgcaagtgcttttgtaacaacatccgctgtaactgtcgaatccttacctccagaaaatgaaataataagattttcttctttgaatcgcgaagctgtttcttttacaaacatggaagcttcatctacgaggtaattaaatctgtctctatttgcattgataaatctctcagtatacaattcaaaactatcgtatgtaagtaattccttatatttaaccacgtctttggcaatctgctctatatcggccttttcaaagtctttttttgataaaaccttcactgtaccatcaatgtaataacgacttcctgttgcccaaacagacgcgtctgcatatgtatttggggcttttcccataagaagctccattaaaaggcgttcttcgggaaatactggtctaatatcttttgccatatactttgtttttcttccacaacaaggacatttatctttgtaagaatcagatatctgtttgattattggtgttttacaagaatcacaccaataaatttcaacaggaatctcttcttccgtttttttgccacatactggacatttatattcatttgtctctattccacatgacctacaccacatatttatttactcctgttctttattttgatttggtatgatctccgcgatatcattcaactgacaaccgagcccacagcaaattttatccaagacatcagatctaacagtttcacttttttctaatttcgcaattgtcgtatagctgagtcctgtcatcttcttaagatctttcttcttaagatttctatctatcattaacttaaataatttcttatatgatacagccatctttgacctccatattccaaaatgagcaagtaacacgttgtatattataccacatatccgttaaaattgatacgttcgtgtgaatattgtcgttttaatgtgacggctttctttattaccatatggcaacaaattggccgtcaacatttattcaccacatcatcgtttgcttatatataatatgtcagaattcagagtcctaaaaaaattacatacagcatttaaacacacttttttttctggtagtccacatgaagaagatgcccctacagattgtgctaattgaataacacatacataaaagcgccagctttataagccgacgcttgtttgttttatttagtcttcactttattgatgatgatcgtgtcattagtagactgaacatcaatcttatcacccacatgatatccaagcgcttcgagccactgcccttgaagttgaatttttggaatctgttgcttactatttaaactaagtggcgcctcgtatactttgaggctgcgttttgatttatacattgtttcctcctatatcccgaattggaaactaaatgttaaatttgctatcctccgaacggaactaatcaacgggaaaatcacaactttgaaagatatcattctacattggattatcgcacaccagcggaatgttattatcctgcaatactaatgtcatatgtcgcttaacatctgtaaaggaaataagtttatcctacttactcttctgcagatacagtaacttatcaacctatcagttcattataaaagtcttagatttttgtcttgacaactgaaccactatagtttttcctatgtataatagagtagtcacactgaaataattttatcttttatttcagtgcatattctaatttatatattatgatgacaataatgccttttggtttaacacttaataatcctcttgtagttgttttggccttatcaccttctgattcattaatcacaacaactcgatttagctaattatatttcataagttatcgtaacaccatcggaaaattctctttactatagtattatttatatcacattactcttattcacctctgtatttctaaattattaatgccttaacataaaataatccgatatttttatatcagactatgtaaaaatactataggataaatgcagaaaccataatacagtccaataaataatttactattcctcacatggctgttaggaattttgttatgcaaatattttgttaaaagaattgcaattattacaacaacaaacatacttactactaaatgaaatatagaataattattcaatccaaaaaaaattataaaaatgacacttaatatagtcaaaagatctgttgaagaagaattttcttctttcattgatgcaaatttatcatagcgaattggatttaacagaaatctcaatatctcataattcggtaagaaataaaatgttattccccaaagtataactattaatgatttactaatattaaatccatacagcaggagtgtcccaaagtttgtgtaaaccttcaaactgatgtaagataacattactcagtttggaggtttttattatggcaagaagaaaaagtgattcaccacaaaaagcagcaatgcgcgaaatgatgcagggatatctcaaggagaatgatatcagtatcaaaagcggaaacgatgttaattccatcatgcgggacatgatgtctgttttattggaaggggttcttgacgaagagcttaatgaggaactggggtattccaaatacgattaccgcaataaagagaccgataacagccggaatggacattccaggaaaacaatgcgtaccagttatggggatatggacattgcaatacccagggaccgcaaaggggagtatgaaccgcagctgataccaaaatatcagaatacggtcactcaggacatggaagaaaagatcatatctatgtatgcaaaaggaatgaccacgggagacattgaagcacacttaaaagagctttatgatctggatatttcagacagcacgatcagccgtattaccgataaaataatgccacttgtaaaggaatggcaggagcgtccactacaggagatatatgctgttgtttacatggatgcgatccactaccacgtccgcagcgaagggcgtattgtgaaacgtgcggtatacattgcccttgggatcgatatggatgggaaaaaggatgtgatcggcatgtatgttggggaaaatgaaggtgcgaaattctggctgtctattattaacggattgaaaaaccgtggtgtgcaggacattctgatcgcttgtgtggatggactgaacggatttccacaggcgatcgaagcagtttatccaaagaccgagatccagcagtgtatcatccaccagatccggaataccacgaattatgtatcctataaagacctgaaaaaacttatggcagatttaaaaatggtctatgcagcaccggatgaagctgcagccctggaggaattagaatcttttggtaaaaaatggaacagcaaatatccgaagatctataaatcctggagcgaacgctgggctacactttccacttattttaaatatcccaatgaagtgcggaagctcatttatacaacaaatgcgattgaaggattcaaccggcagctgcgtaaagtcactaaaagcaagactgtatttccaagcgatgacagcctcttaaaaatgctctatctagctactatggatatcactaaaaaatggaccgggcgccgcagggactggtcccagatacgagcccagctggaaatctactttgaagaacggctggaaaaagcagaattctagagattctatttgacatgtgcatttatacctgtataatgcagataagagcagaaaaccaaaatctggtctctgctcttaataactatcaataaaatcttatgtcagttttttgagtttacacaaaacttgaaacggtctctatacagccaataaagatatagtaattgttataccaatcaaacattgatttataatatttaataaacaatctatttttttcatattacttatccattctagtcatttaatattttgaaatattatgtagtattacattaaatagtctaattatactaacacctctaactaagaaagataggtgtcaatcaatctaactaaataaatcatttgtatttcataatgctattattttttcaaccatttttttattaatttaacaccactttacaacttttttcataaaaaaatattatacagaactttctgatgtataatgagcttaccaaaaacattatgaaagaaagtgattctgtacgataaaaacattatacaacgaaaaaactctgattggtagacttcgccgatattttttgatttattttgaaactttttctgcacctacagcccatactgctttaaagctgataccagatccattgaaagcacatccagtttttctatgtgttgatgataccatggtatctaagtttggcaaaaaatctcaatgtacactgttttgtaagtatcatgctatgcgtgcctgtcctggatcatgataagatatcttatctgtctgttcctcttggctatcgcatgtgtcaaaaaaaagaatccaaactggaactggcagcttccatgatccgtcaggtcatgcatctttggcaatcaggaagttcttgcctatgtcactgatacggaaaaagggaacggcacaaaacgtctgtttgtcagaaaatctatcatttataaagttgtaaactggtgtttgatatttatatcaaataaaaaaggaagaactaatcaagctctccctcctgcctgtaggattcgcaagtttctacagaacgatcatttcaactatacaatatcatttttaaattatcaatatttcctactcctccgtcttaatcgaactaatcaccacatcccccaactgacatcccactttccgaacaacaatatcctcaatctgactcctctcaaccttagacagatccttcttattcaccaacacatccaccttcccattcgtaatcgtaacaatactattcaaaaatcccttagcccccagcagattctccgctgcagtctccatctccatctgctctgacaacattgccagtttatccaccgcatcctgcttcacactatccttcaccgtctgatccttaatgatcccctctaatgtatcctttgccttactatgcacctgctctcgctctaattttgctttcgccacataattactaacctgagcatttgtaagcaccgcttctccaacatcagtcacatcatcggttactgctgctgcactttcttttgccacattctttgaaactgtcttcgtcttgccattcttcgtcccagccggatcgtatttctgactataatttacataccctgcaacagcgatcacaaccgctaaggtcataatgatcatctgatttttctgaaatacttttttcattgttaggaatcctccatttttaagactttcactttataagatgaaatatgaaataacacagaaactgcttcaacgatctgattcttgataatatcattcccaccgccctgggcgacaacgaccactccttcgacaactggttctacttctttgatcacatatggaactttctttccgtcttcttcgactaaaacggtctgttcatcttctttgactgttttttctttttcactgctgctttgttcatagggactgtctttatttacgacagcttctttggatgaattaacggtgatcatcacttttacttttccgactccttctacatgttttaatgcattgaccaatcgtctctcctgctttttcacatagagatcggtagaatcttcttttgctgtggtttcagtgctttgtgcgttcttctttgtcttcccggatgggatacttacgatgatcaggctgatgccaagaagtaagatcaggcaaagttttggaatgccgatattttcgatcagatgttgtagtttttccctctctatcatatttcttctactcacttatatttatattagattccttcatattatagaagtttgaaattgcggtttttagtttctttgtatgacgaagcttgtctgttttgatgtcgatcttctcgatggttcctttttcatttacctttgagtcaacgtctaatactttgagatcgtattgtgaaaataatgttgtgatctgttctttgatctgattttgtttttcctcttttgcaccatctaaaaatgcagggttattttctcctttgactgcggttgagattgcctgtgtcacgatatcttcgttggataaataataggatattggctgcatcattagggagatgagcataaatcctgtcattaaccgaaggtatggacggtagatgcttttgtcgcagagctgatcgatcagtgttgttaagatcagaaaaaatatgatcattttcagataatccataatccttaccccgcataataattgacgttggttgagaatgcaatcaatgccacggataggataaataacagtgccatcgtaaagatcatcgaaagcattaattttccgctttgaatgactgcatccatcgctccggtgatccttttgtcggatattggctggatcatgattcctgccagcagataggtaagaacaactgctgtgatctctatgactggtggaacgatgatcacgatcagtacaaggattccaacggctccgatgctgtttttgatcacaactgccgaaccgatgaccatggtcatggctgaattcaaaccacttccgattcctggaatggcactcattcctttttggagaactgtatttttcatggaatcaacggctggaaggatcatcgactggatcagctggactcctaacaggacacttaggaatcctttgagcaaaaacttgatcacaccttcgagcgttttgcatagtcttgaaaaatgttcttctttagatatatggttgatgatctttaagacaaataagatcttgatcatcggaagtaatacaacatttgtaagggttgtcattgcatagatcagcagaagatagaattcataaactgtcgttgatgtcgtgatcccggaagttgagacaacagccagtgaatatgccatgatcattcctttcatataatctgccattaaggtaacgagctgcgtcactgttttgtttaaataaaaaaaggaatgtaccatgacaccgcataggatcacataagtaatataaaatgcactattggctgtgctttgctgaaaaaaggaatcggacagatttttaaagatggctgcggtaaatgcgatcagaaggatttctctgatcaggtctttttggatcaacatacggtttaaaaagacctctttcattttggctttgattgtatgcagaacaccttttacatttccgtggatcagctgttttactaattgtgtataagatagatcgatctctttgtcttttaaggtggtttccacattggtaaacatatcttcgttgagttttgtttctttggctgaaatatcatttgttcttgtaaggatcagtaaaaatagcaaggttagcaggaatattctttgtttcatgtgccatttcctaatagtttctggatcgttccaagcagcgattcaaagactggaagtccaacgatcaggatcgctaatttccctgcaaactcgatctgctttgcaatcgatgcctgtcctgcgtctttgcagatattggatgcgaactcgcagatgaaggagataccgatcagttttaaaaggatctggaagtagctttgtgggatttttgaataggaccggatcatgtcaaacacggttagtatttcctccatttgttttagtccatacattgccagaagaatgcttgagatcactgcgatcacgactgcgatctctggacggatcgttttgatcttcatggcgatcagacttgcaacgattccaaagactgcgacttttatcatcttagtatccgcctccaatctctaggatatcgtaaaaagtgtctggacactttcaaacagatcatagatatacggaatcacccagccaaggacaaggatcagtccggcaagtgtgatcaaaaatgcctgttcgtctcttccggaatgttttaagacctgcacaaggatcgttacaagaattccaacggctgcgatccgaaaaatgatattgacactcataacccctccttgtcataaaaatgtctggtagttgctttatagtaagatgatcacgatcagaacgcttagtgatataccgaggcttcggtacatcttgcagttctttactacttgatctttcataaggaagatctggtcatcgagttgttcgatcgtcagcaggatcgttttctcctgcatctgttggtcaagatatccgatcgtttcacccatgttttttaagatttcataaaactttggttcatagatcacttgttttagtttctgctcagcggtctgctgccatactttggcaaaggattcttcgctgtgtgtctctaactgctttgctaccttttttagaaatggctgatattccttctctgtctttgtcgatatttttaaaacagcttctggaagtggggtaaatccatagcggatctctccttgcagaaggtataacattcgtttgatcgcaattccctgttctagacgtttttgttcttttgcggctttgtgaaatccaaatccgatccctgcgaagatcacgatcaatgatcctaatatcttgatcaatttaggaccaccccgttttcatctatgatctgtgcgatatagcctggctggtttcgctgttctaagatcacgtagcgctgaaacatctttttgttgatgatctcccgcatatagggattcttagataacgattctttgttctttccatgggccgttgcaagaatgctgcagccacgataggcacagaaaaataaggcttccacatcttctttgcttccaatctcgtccacagcgatcacatcgggggccatggatcggatcagcatattcatgccctgtcctttttcacatgcatccatgacatccgtctggatcccgagatcattttgggcaacgccttggtagcatgctccgatttcacttcgttcatcgactactccgacggtctgtccttcatcagagatttttcggatcatatcccgaagcagagttgtttttccacagccgggtggtgagataatcagcgttggaatgagttttcccattctggtgcagcgtgaatataagatgtccgcacatcctttcacttcatgtgcgactcggatatttaacccggaaatatgtcggattgttttgactttgtcatgatccatgacaacggttccgcagataccaactcggtgtccgcctcgaatcgttaaaaatccttgttttaactgttcgatataagcatacatcgaatagctgctgatatattccatggcttgtctgatctcttgtgaggttacgatatgtaattgttcttttcttgttgtgatctttccctgttcggatagatagcaggtttttgcgttgtattttaaaatgactggcttttgaatacgcaggcggatttcctgaagttcgtcccagttgatgcctgcctgctttatgatcgttctgatatgtaatggaaggattcctaagatttcttcctctttcatagatttaaaaacacctccccatttttgtataatccaaatatatgtgatggaaggtgtttttatgaatgttattttattttttcttctgataatatggtgcgatctgatcaaaggattgtctgagctgatactggaagttattttgcttgacaatatttgtcttctgggtgacaaacttgtctaacttctgcatatactcttcttctgtgacacttccttctgccacataagtaagacctttttcccagcttgcggttaaggttgggtttaagagtgatccaatggatgcactgacaacattgacgatcatctctccggttaaagtcggtgttacgatctgtgtctttttatttaatgcaatgtatttattggacactaatttctttacgatctctgctcttgtcgcactcgttccgatcccgcttcctttgatctgttctcttaaatcttcatcttcgatcagctgtcctgcattttccatcgcaaggatcagggaacctgagttgtatcgttttggtgcggatgttgttccatctttgatcgtatagtctttcactggaagaggcatacctttcttcaaagatgagatcgcatggatctgttcttctgttaattgggcttctttcttctgtccgcccattcctgtgacttttaagtatcctgggccttttaacatcttaaagtttgcaaagaatgcttcgcctttggtctgtgtctctaatttgatttttaagtacacggctggcggcataaaaatgcttaggaatcttctggcgatcacatcgtagactttctgtcccatctctgagatccttgataaactgcctactgcctgtccggttggaatgatcgcatagtggtcggtgatcttcttgtcatctacgtatttcgacttgatgattccctgatacttcttgccctgcatgatctcatttgcaaattctgataatggagtgtagttgtttaatcccccgatatttttataaatctctttggcgaccgtactggataagactctggcatcggttcttggatatgtaaccagtttcttttcatataggtcctggaccacttttaatgtctcatctggacttagcttgaatcgtttggaacattcattctgaagttctgccagattatataataacggcggattcttcttttcctgtcgtttggatgaggatactacgatcgtcttattgttacttccatcttctaaatatttgatgaattcctgtgcatcgttcttgtccaggaatccgttatccttatatagtttcttggactcaaagtactttgatcctttcactgctttccattcggcttccacttcaaatccctggcagtcaaagtgtcctaagattctgtaaaacggtgttggcacaaaggtacggatctctcgttctctcttgacgatcattccgagaacacaagtcatcactcgtccgactgctaccactaagcttcgtttctgatttaaatagttaccgagtgtccagccatatttgagtgtcaggactctggagaagttgattcccatcagatagtcttctttggctcgcaggtatgcggcggcggctaggttgtcgtattcacttaagtctttcgcttcttttaccccgcggatcacttcttcttttgtctgggaatcaatccagacacgttttttcttcttgtctttgctgacattggcctgctggtctaccagacggtagatgtattctccctctcgtccggagtcagtgcagacgtagatcgtatcaatgtcttctcgattaaggagtgaagatacaatattaaactgtttttgtactcctgggatcgtttcatatttaaatgtatctggaataaatggaatggtttctaagtcccatttctttagtgcagggtcatactggtctggataagacatggtaactaaatgtccgacgcaccatgtgataactgccttgtcgccttccatgtatccgtctctgttttttgcatttatattcagtgccgctgcgaattctcttgcgacacttggtttctctgtgataaatagtgctttcaaaaaattacctctttctaaaagttttacgatatattataacataaccattgaaaacatgatataattaaatctagttcttgtggaattcatatttgtagaatcatgattccacataaaatttatactgaaaggatgatgagtatgtttttaaatgaagcaaccaaacttcgtgcacaaacaattatcaagggacttgaaaaaagaaatatgcatggtgttttctgtgcaaccaaggaagacgccctaaaacaggctcttagttatatcaaagagggttcttctgtttcttggggtggttctatgagtgtttctgagattggactgatggatgccttaaaggaaggaaactatcatctgatcgatcgttctgttgcaaagaattttgatgagcagcgtgagattttttctaaggctgtcttatctgattatttcctgatgagctctaatgcgatcaccttagatggagaactgatcaatatcgatggaactggtaaccgtgttgcgtgcttaagttatggtcctaaacatgtgatcatgatcgttggtatgaacaaagttgtcaatgatgtggaagatggtattaagagagttcgtaattttgccagccctccaaacacccttcgtctcggactgaaaaccccttgttctatgactggacgttgtggtgactgttatggagatacctgcatctgcagtcagatcgttgtgacaagacgtcagagtgcaatgatgaaagatcgtgtcaaagtgatccttgttggtgaatctctaggttattaaggcactcgctctttctatcaaatatcacagaacacagacattttatcaggcattttcactggatattttatcgccattccagtgaaaatgccttttctattcttgaatttttataacaatcatagtaaaatcaaactatattatgacacaattcgacattttttataacaatattgatattatgaggtttttctatgaattatgatatttgccattcatctatcacttattttccactgcttccgctttctaaaaccgtttcatatgaacgcaaggtattggatatccgacagatgcctgctcaggttttgtttcctcattgggatgatgaatttgagtttatatatgttctctctggcatgatggaatttcgtgtccggcagaaggcttttctggtttcttctggggaaggtttctttttaaacactggggagattcattccgcttgtacatatcagtcttatgactgccgctttgttatctaccggatctgcccttctgttctttttcagacagaagataatcctttatatcaaaaatatatcaaacctctggtcgatcatccttcctttggatttttaacgttcgttccaaaagtcccttggcagaaatatatccttgaaatgatccgcaaaatgaatgatatctgtgaccgtcctgttgatggttatgaattgaagatcaaccattttgtaaacgagatcttttattatatctttcataatgtgaatctctccaaagaactatccttaaaagaatccagagatttggaacgtatgaaagatgtgatgatatatcttactaaaacgatcgaccaaaagcatacactcgctgatattgcttcttactgccatctaagcaatagtgaatgctgccgactctttcaaagaaatgttcatctaagtcctgtggattatctgaatcagcttcgtattcatatgagcttgtctgagatcataaaacatgagaaaaagataacagatatcgctaagatgtatggtttctctggcagcagttatttctctgaaatgtttaaaaagaccctcggcataacgccaagagccttttataaatctgttcttcagcaacaaactctttcttctaacgctgatcccattcacggaaggcgatgaatttcgtcttccaaagaaggctcaatgctggtgttaatgcccagatcatctttgtctcttcttgcatgatcagatcgatctttaatatccccgcatacagaattaccagtagtaacgtaaagatcactagtaatccatatgcaacagaataagaattatgtactttctgcccgatcttctcactaaaataaaaacgatccagtgtcagagaaatgattgaaatcactgataaaatgatattgatcgtataaaatgtatgcatatccatatgattaaaccaagttgccaaaactcctagaaagatcataatctgtgcataccataatactttttcctgtttttcatattgatttctcattgattgaaacctctttttctttcttttaataatgaataaatacaggatctccgatcttcgtcaggttatatacagatcttgcatctgataatgttaagttaacacatccatgagatccattcgtcttataatatgttggtgaccagcttccccagtctcctctgctgctgtaatgatatcctgttcctgtccacatgatccttgtccaatatcttgttggaacactgtaatccgcacctgttaatgtctttgtaagtttcttctctttgatgtcataaacaccggttcttgtgatacgatctggtgttgcttttccagtgatacaggttgtgctgaatacaagttttccttttttgtagacgaaaacttcctgtgctgacaggtcaacttcactgtagttttgtgtatcccagtcattttgtttgttcgtataatccatacgatatcctttgtggctgtagactggttttaagcttgtaagtaaagcctgttcattctccttggaagggtctttctcataggctttgatcgcagattcttctggtgctttctttaacgctttcattgtctgtgcgataactttatcataatcgatacgccatccatagtctccaccactgactttgatcttcttgccagaatgtgtcttaaatgttcttgcgattccctgtgtcttgtattttaagcaaaagctttctaaccatttctcgacggcaggctgatctaattttacagtatgtctctttgtgtttactttgatgcagtcttttaacgcatctggacctaatgtttctttgacatcattgcccatatcccactgaatgaaatgtaataaatactcattgtaggttgtctgcatctgttttaattcttcatcatcatgatacagaccaggctttttatagacgtccggattcttcttttcatctgtcagattcagtgtgttacttaaagactctatggatttctctactgcgtcataaaatgctttacggtttaagtaatttccttcatcttccttctggattacaccgtatttcttatctgcagaatatacgatcgttgcatccactggttttgtgatcttatatgtatcactgcctttgatcaaaacggattgttttaatttggcctttaatttctgctctgataatgcaactgctgtcactttggtttttttgccaccaaagatcgttgaaaatacactttggctgtgctgctttttgtaagcatcctttacatgtgattctgtcttaaatgcaagatcgatctccttaccggaaatcactttctgtccgttatttcttcccttgatctttaacttgtaagaatcaatggatttctttactttcttcactgattcttcgtatgtcattcctgacacatcaactttgttaaatgtactccccggataccaacggttctgataatgggcatggacaccgatagcggctgctattaaaacaaccgctacggcacctcctatgattcccccttgtttctttgtaatcctcatattgatttctgcctccaaatacgactctgtgatggattattcatagagtggatatttttctgttaatcctaatactaattcgtttgcttcatcaagtttcttgtctaataatgtcagacgaatagcttttgcgatcactttcatatcgtcttctttcagtccacgagttgtaacagctggtgttccaagacgaagtcctgatgttacgaatggagattttggatcgtttggtacagtattcttattacatgtgatatgtacagaatccagtactttttcagcttcttttcctgtcagatcatatttcttaagatctactaacattaagtggttgtctgttcctccagatacgatatcgaatccttcttcgatcagtgcatttgcaagagtatctgcattcttcacaacctgtgtcatatattctttgaatgatgggtctaatgcttctttgaatgctacagctttaccagcgatcacatgcattaatggtccaccctggattcctgggaagattgctttgttgaagttgtatttttcgttcacttcattgctgcacatgatcattccaccacgaggtcctcttaatgtcttatgtgttgtagttgttgttacatgagcataagggattgggctctggtgtaatcctgcagctactaatcctgcgatatgagccatatctaccattaaaactgccccaactttgtcagcgatctcacggaaacgtttgaagtcgatcgctcttgcgtatgcacttgcaccagcaatgatcatctttggtttgcattctaatgcgattctttctacttcatcataatcgatgaatccttcatcattaactccgtatggtacgcagtgatagttcttaccagacatgttgactgggcttccgtgtgttaaatgtccaccgtggtctaagctcattcccatgtatgtatctccgacattcaatactgcgaagaatactgccatgtttgcctgtgctccagagtgtggctgtacatttacatattcgcatccaaataattctttggcacgttctcttgcaagatcttctaccacatctacatactggcatccaccatagtaacgttttcctggatatccctctgcatatttatttgttaaatgacttcccattgcagccataacagctttggaaacaaggttctctgatgcgatcaactcaagatttgttctctgtcttgttaattcgttttccattgcttctgctaattctggatcgtagttctttacttcgctaaaatcaaacattgttttctcctttatatatttatgtaaaataatattgtgtctcgtatgttgtgtcgtattcttatgatcattcgattacctgatctatctgattattcctggaactgttcttttaatgcttctactgcacgttctacacgactctctttgatcagaacagtgatcttgatctctgatgtgtagattaagtgaatgttaattccacgattatacagtgcttcaaacatcttagaagctgctccgctgttagacatcattccagctccgacgatagatacgattccaacttctttatcactgatgatatcttcgtaatctgcttcatcaaatgctttctttaatgtttcaacggcatgatctgcttcatcctgtgctacaacgaaagaaatatctttattctctccacgtccgatggactgaaggatcagttccacgttgattttttcttctgcaatggcaccaaaaacttttgctgcgattcctggctggtttttgattcctttgattgcgatcagtgcaacttcagagttagactgaacaccgctaaataacattttctccatctgattattcctcctctggtgttgaaagttcaattccaagttcttctagctgtaatgtatcaaccggtcctggagcctgtgtcatcaggcaggaagcatcttttactttcgggaaggcgatgacatcacgaatgctgtcttctcctgttaaccacataacaagacggtcaagaccataagctaaaccagcatgtggtggtactccaaatttgaatgcatctaataagaatccaaaacggttgtaagcatcttcttttgtaaatccaagagcttcaaacatcttctcctgaatatcatcctgatggatacggattgatccaccaccaagttctgtaccatttaatacgatatcgtatgctttcgcacggacatctcctggtctttcatcaatgaattcaagatcttcttcaaatggcattgtaaatgggtgatgcattgctgtgtaacgattctgttcatcgctccactcaagtaatgggaattctgtaacccataagaacttatactgggatttgtcgatcatatcgtactgtttcgcaatgtgaagtcttaagttaccaagtacatcaaagacaactttgtctttgtctgcggcaaatagtaataagtctcctgcctgtccatccattgctttgatcagtgcatccatctcttcttctttcataaatttagcgaaagatgatttcactgttccatcgctctttaactgaatatatgcaagacctttcgctccgaagtctttggcgtagtcaacgaatccatcgatcttcttacgtccaagatctcctaaacctttagcgtttaatcctcttacagatccaccattctctaatgctcctttaaataccataaagtcgcatccggcaactgtatcggatacattcgtaagttccattccaaaacgcatatctggtttatcagatccgaaacggtccattgcttctttataagtcatgcgaagcataggaagctgtacatcaatatctaatacttctttgaagatcttctttaacagacgttcatttacatcgatcacatcatcgacatcaacaaatgaaagttccatatcgatctgtgtaaactctggctggcggtctgcacgtagatcttcgtcacggaaacattttgcgatctgatagtaacggtcgaatccagagcacattaaaagctgtttaaacagctgtggtgactgtggaagtccgtaaaattctcctggatgtacacggcttggtacaagataatctcttgctccttctggtgtactctttcctaaaactggtgtctcgatctctaagaatccttcatcccctaagaagttacgtaccattcttgttacatcattacgaatgcgtaagtttctctgaagatttggtcttcgaagatcaagataacggtattttaaacgaagttcatctttgactgtctgattctcgtcaattggaaatggaggagtttctgattctgataagatacgtaatgtatgtaccttgatctcgatatctcctgtcttcaagttctcgttaatcgctgcacttctcttctctacagtacctactgctgcaacgacatactcacttcttaaagagtttgccttattatagtcttcctcagataatacttcctgatcaaaaactaactgtaagattcctgagcggtctcttaagtctacaaatataagacttcctaaatttcttcgtttctgtacccatcccatgacagtgacttctgttccgataagtttgttgcttacctctgtacatcggtgggatctggctaaacctgacattgattctgccatgatatttcctccttcatccttttcactttgtacgaaaggcagagcccgtatcttcggttctgccttatatattcttttatgaatcttttcttacaaggatctgttcaatctctgcagcgtaaagtacgtgataatccttctctggataccactgttcatctaaagatttatcaacaaatccttctggatccattggctgagaatataacttcttacagatcagtacgatctttgcttcctcaaaaaatggaattccattcgcatctgttggtgtcagacgtgtcttcgcgatcttgtcttcatctcttccagatacacttccaagatagcttaaatccttcttaaaagtatcatcatagaaagataatgtaaatgattctgactggtcaatgaattcttttgtatatctttgtggtcttaagactgtcacagcaacattcttaccccacataacacctaaaccaccccatgaggcagtcattgtgttaacttttccttcctgattctttgcagtaacaagcatccattccttaccaatcaggcgaaatacgctttggtcgaaatcttctggtgccacgatcgcatattcactcatgcatgttacctcctttcttgtaattattactcattatatatgattttgtcaaaaatgtcacgaactagtataagaaagcatgattttattttaaacaatctgcgatcttatcaagcgaaatggtcgtaacttctcttgtttccatatttttgacatttccttcattcttcgctaattcgtcatcaccaatgatgatcgtattcttggcattcagcttatttgcatatttcatctgtgcttttacgcttcttccaagataatctgtttctacgacaaatccctgatcacgaagatctacaacgatctggtaagcttttgcttttgcttcctgtccaagaattcctacataaaggtcaatatctcttgtgcatggaagatctactttctcttcttctaagaaataaaggattctctctacacccataccaaatccaacagatggcatagaaacttttccatcgatctcatgaacaagattgtcgtaacgtccaccaccacataaagtaaatccatcttcatttacaaattcgaatacggtctttgtatagtagtctaatccacgaacgatttctgtatcaacttcatatggaatatttaatgcatctaacagactctttaattcttcaaaatgtgctttacattcatcatctaaatagtcgatcgttcttggtgcatctttgacgatttctttgcattctggaactttacagtcaatgacacgtaatggattcttttccatacgttctctgcatgtaggacataaatgttcttcatgttcttttaaatatgctaataatgctttgttgtattcttttctacaattttcacatccaatgctgttgatgtgtaattttgcatcttttaacccaattttcttaataaaagtggatactaatgtaatcagctctacttctgctaatggactttccgctccgacaaattcaactccaaactggtggtgctgtcttaatcttccactctgtggtttttcatagcggaatgctggtgtgatatagaacatcttgatcggctgtggctcatttgccagaccattctgtaaatatgcacggatcgctcctgctgttccttctggttttaatgaaatgcttctgtgtcctttatcttcaaatgtatacatctctttctggacaacgtctgttgtttctccaacacctctctgaaaaagctctgtatgctcaaatactggtgtgatgatctcgtgaatattataggatgcgcataaatctttgaaaatattctctaaatatgtgcgctggtccatatcttttccaaaccagtcttttgttcctcttggtgcctgtgtaatcattcttgttcctcctcaaataattcatccagattgcctttttccataacagtttccataactccgtctgaaaatgcgactctctggaatgctaaaaatactttcatatcaaaattctttacttcatcgatcatgatatcaagtgcagtctcaacatcaaatccctctctataatccctgtttgagatcaatgctccgaaaatatcacatacatgcatgatccttccaaccaatggaatctgttttcctaccagattatgtggataaccggtgccatcataatgttcatgatgatatagaactgcgtctaaaaccgtctggttataatcgtaatctgcaaggatcgcatatccaatggatggatgcattctcatatatcttgtttcgtcaacagccagaatctcatcttccactttctcattcatatagaaattaagtcttactttcccaagatcatgtaacattcctgcaaccgcaagatcataacacacttcttcttgtaatcctaattccttgccaacaagataagccaaattactgacaatgataccatgactgatcgtttcttttatatccgcatggatcggtgtctcaatatctgttcgtccataactgattgccataatcaaactcctgtttatatcatctttaattcttttctatgaatgatctcatcaattcgtgtaatgtattgctttatatctttaagattttcgatgcggtccacctgatggtcttcctgatggacgatctttgaagatgtaccagcaccaactgctataatatcatgtaattcctccataatcaaaatattatagagacattcttttcctttttttgaaaaaccgacattctcaaggttccctggaatgtttttctgccggtataaataatatggttccatattcatatctcttgcacatgaagcggcataagataccatctcttcactcgctccaaagtgatatgtatctttcattcgattcaatctcgatgaacgcttgactgcaagtgcatggaccgttaaactctctggatcaagttttttgatctcatctaaagtataggaaagttcttccatgccctcttctggaagcccacagatcatatccatattaatgttatcgatcccagcctgtctcgcaagattaaatttctctttgatatcttgtgcgaaatgatttcttccaatgagttttaatgtcttatcgttcattgactgtggattgatactgatccttgtcacaccatatttctttagaatctttaatttctcgaaattcaagctgtctggccgtcctgcttccacagtgatctcctggatctttgaaaatgggaatctcttattaacctcatataacagatattccagatcttcttcttttaaagatgttggtgttccaccgccaatatacatcgtctgaagttctttgtgtgcataagtcttcgccacaaaatccagttctttcaataaagcttcaagatagtcttgtacaatattctcaaattgatcgatcgaatacgatgtaaaagaacagtacaaacatgtgcttgggcaaaacgggattcctatatatagactgtatccttctttgtatggaaatgcttttagcagttctttctctttctgaacggtttctgtacataatcttgctttttcttcggatgccagataatccttttgaaatctgtgaatgatctcttcactgctctcacccttttcatatccatcaaaagcaatctttgtcggacggatcccagtcaacgttccccatggaagctgtttgtctaatgctttggaaaacaactgatagattccttgtttcatcaggtttttaaaaatcttcttattttcataatcaccaaataactggatctcatcttctaactcgccctttttatatagattcatgacgatttcctgatctttataatccacgtccagtataaaatcatagatagaatcaacgtgatccgtcaattctatcttctctccaagcataaatgccaatattaaacttcgaatgtcatattcataaatgatcttgttctgaattaatccaatcataatctattgcagaaacggattgcatctgctttcctcctcgatcgtcgttggtgatgtatgaccggatagtacctttgtccatggtgggagtacgaataatttctctctgatcgctgtcagaagatcattcaaattgcctgtcggaaagtctgttcttccaatgctcatctggaacagtgtatctccagagatcagccatccataatctgcaaaataataacatactccaccttttgtatgtcctggaacatggatacattttacctttgttcctaatacatctatgatctctccatctttcaccagatgattcgcttttaatgagagatccattcccatcatcgctccgagattgagctgtggatctgccagaacatctgcttcatcttcataaagatagatatcaagatctggtttttgttccatcagatatggaagggccattacatgatcaaaatgcccatgtgtcagacatacgcctgccagttccattccatcttcttctaatgtattcataatacgttctccctgatctcccggatcaaagacgaatgcctgatttgtttttgtattctcaacaatatagcagtttgtctgcatctgcccaagacagatcgttaccatcttaagaggtctgtcaagtcttaatgttgtttcgctcatattttcacctatcctgctgttctttctatgtcgatcacgccttctacattcctgatcttcgtaataatacggttcaactgctctacgcctgtaatatcaaaggacatactaagcgttgctcttcctttcttattgtttgatacgttgatcgttatgatgtcaatatctaattctaagaagatctttgatacttctgctaacaatccctttcgattattggcataaatattgatctctgtcgtgtaagtctgtgttgtatctgcttcacttacctgccattcagcttcaataagtcttgccctgtcagattctggcatattcagaaggttcacacaatctgttctgtgaatcgagattcctcgtcctcttgtaataaatccaacgatctcatctcctggtactggattacaacactttgaaaaacgaacagcaacatcattcgctccacgtacaacaattcctcctttggatttctcatcctttttcttctctggattcgctgctgccgcctgtgctgcttctgttgttttctgcaagatctgttcatccgtgatcttttgtttctggatcttacggtcttcttcctgcatcttattgataacctggccttcttttaaaccaccatgtccaacagctgcacatacagaatcccagtctttaaatccgtattttagttcaaccttcttaatgtattcaggtttcatgagttctgggagcctgatgctcttgctcttacagtatttttctaacagttccttacctctgacgatattctcttccttgaattgtcgtttaaaccactgattgatcttacttcttgcctgtgctgattttacgatccctaaccagtctctgctaggtccttttgaattctgtgatgtaatgatctctacacgatcaccattctgcaaatgataatcaaatggtacctgtcttccattgaccctggctccaaccatcttattaccgactgcactatggattgaatatgcaaaatcgatcggtgtcgaaccattcgcaaggtttttgacatctccattcggtgtaaaacaatatacctgttctgcaaagagatccaagttcgtcttcagcaaacttaaaaactctttgttatcatccatatcacgctgccattccagcacttctcttaaccagcttaacttctcttcttctttgttaagtcccttggtattattattttctttatatttccaatgggctgcgataccatattcagcaacacgatgcatctcaaatgtacggatctgaatctcaaatggatgtccttctggtccgatcaatgttgtgtgaagtgactgatacatattcggttttggcatcgcgatataatccttgaatcttcctgggattggtttatacatctcatgaatgatcccaagtgccgcataacagtccttaaccgtatcaaccttgatccggactgcaaataagtcataaatctgatcgatcgtcttatgctgattgaccatcttcttatatatactgaacatgtgtttcacacggccatcaatctctgccttaattccagcgtggtcaatatgtcctttcacttcgtcaacgatttcctgaatgaacgcttctctttcttcctttgcagaatcaagagagcgttctaaatcttcataaacatctggttttaaatatcgaagtgccagatcatctaattcaactttgatcttggaaataccaagacgatgtgcgatcggtgcataaatatccatcgtctctctggatttctctttttgcttctctggacgcataaactgcatggtacgcatattatgcaaacggtcagcaagtttgatcaggatcactcggatatcttttgccattgcaagaaacatctttcgtaagttctccgcctgaacttcgatcttgtctttggaatagcttaattgtcctaactttgttacgccatcaactaactgggcaacttcttccccaaaatctcttacaatatcttcatgggttgtttccgtgtcttctactacatcatgaagcagtcctgccataatcgtttctttatcaagttctaattctgccaatatgatcgcaacacaaataggatgaatgatatatggctctccagactttcgtttctgtttctcgtgtgccttatatgctactttataggcacgttctacagcctcaatatcttcttcatcataaatgctttgcatggttgtgatcagctgtcgtttcagttcctcaggcggtgtgaaactatctggactgctgatatccttctttacacgattaatgtttgttctgctttcttgtttcatgcacggatacctcttgtttcttttgattattttttaagctttgattcgcagtaaatacagcgatatacttggtgttctctgtctgtcaatttaaacacatgatcgatttcttgttctacagatgtaatacatcttggattcttgcattttgcaatattcacgatcttctctggaagttctactttgtgtttggactttacactgccattttcaatgacacataccgtaacttctggatctatataacctaaaacatcaaagttcacttcaaatgcatctgaaatcttaatgatatctttcttgcccattttgctgctttttacattcttaatgatcgcaacactgcaatctaactgatctaatccaagactattataaatctgcattccgcgtcctgcacggatatgatctaatacgattccattcttaatgctatcaatgttcatctgcacttacccccagtaattccatgatcaatgccattcttacatgttttccattcaatacctgtttgaaatagcaggctcttggatcgttatcaacttttacagaaatctcattcacacgaggtaatggatgtaaaatagaaagatctttcttggcgatcttcaatttatccatatctaagatatagctatccttcaatcttacataatcagcttcattaaagaaacgttctctctgtactcgtgtcatataaagaatgtcaagctgtggcatcacatcttccatcttatcaacttctgtaaatgtgattcctttcttctcaaaaacatctttcttcagatactctggaatctggagttcttctggagaaattaaaatataattgattccttcatatcttgataatgctttgatcagagaatgcactgttcgtccaaattttaaatctccacaaaatccaatcgtgaaattacttaaacgtcccttttctcttcgaattgttaaaagatctgtcaatgtctgtgttggatgattatgaccaccgtctcctgcattgatcacagggatatttacatactgtgacgctacatatggtgctccttcctttggatgacgcatcgcaatgatatctgcataacattcaatgactcttgctgtatctgcaacactttctcctttagatgcagatgatgaatcagcagaagaaaatccaagaacacttccccctaattcaagcattgctgcttcaaagcttaatcttgttcttgtacttggttcaaagaacagcgttgctaatttcttgtgtttgcacacttcctgatacttctcaggattctttgcgatgtcatcagcgcggtctaataatctatcaatatcttccacgcttaaatccatcggatcaatcaaatgtctcattacatattcctcctaatggtttgtcctaccttcaattctacatttttaggcacctagtgtcaattctttacttctgattttagacgaagaacgcccttgtctaccataaagactggtcgatacgataattttgactttctaagtccctcttctccagcatcgtcttctctgttcacatatttgaaatcttccatctcatggatcacaaactgttgattgatcatcggataagctccttggatatctgcaaaagctttttcaatatgaacgataaatgtatcttcatttgatgcacgttcaccgattgaaaatcctacgacctttccttccgcacgcagaacacctccgacaagtcctaattctttataattgatcacacaatttttagaaacgcagatctcgtcatgtttctctatatcttctggatcacaattttgcatcttccattccatcagcattgccagtacttctaactgattttcatcggaaagtggttcataggaccattcatgattttctttaaaacgattgatatgatttctctttccatgaagtttctttcctgataatgttgcgagtttttctctgtcataaatatattctgagatatctctgtcatattcaatctcataaatatctccaaatatttcacgaaactcttcttccatctcatgagttacaccatgtaatacaaacggaatctttttttctttgcaatcatccataaaatattgcaatactttctttttatttccttttccaagtggataacaaaaagaacctccctcctcatcagtatgagatacaaataatccatctatgatcgcatactttacttgataaaaaggactccataaaataatattcgctgttgcataatcacaacttcttgtatcatctgctaagatacatcgatcaatttcttccttatcttcaattgttggtgttttaaactccatctttatcaactccattctagtgttttctcgtaatatttttatttgtgatatggctgatgattcaaaatccgataagcacgataaatctgttctaatatgatcgtgcctgccagcgaaccactttgtgtaaatgacgatacatgaaatggctttgcttcctctgatcctaaatctccaatataaaaatgaaactttgaaattccctgtacagaactttcattaatcagctgtgcaagccccggacttgtcatactgtctcttccaggcaggatatgataatgttctcccggttcttttaatattttctctacttgttttgcattcttcttatatactacagaaactttcgcgtatgcaccaagacgttttagatactcacccattgcttcctgatacatcttaggatcctgtgatttcttctgcagaatataaatttcaaatttcatcatatcttttaatttccttcaaaaaattgttttaattttttatcttgttttaaagccagctcatatcttttgttgatctgttttgtaagttttttaatttctttgctattttggctttctttttttgcatctgtgatctcatccgtatcatgtttttgattattatagatacagaatgtatcccctttcttcatcacataatacgatgtcatccccggtgcaagtgttttaatcttgcggatcttcatctcatatgttacataaacgatataggattcatcgtctgctccttgtttgatcagatatgtaagattcttatatttcttcacatactgatggattgccttttgatcctcagttaattcattcgtatcttctaccatattcttaagattttccagatcatttttctgaacgctctcataatatgttttcataaaatcctcaactgcttttttctcagtctctgaatcttccttcttcgtttccgctgcatcatttgtttctctgatcacgccttgtgaggtattcttttgtgttgtttgttgaaaaatcttttcatttgtaagtcgttcttgtttcatctggtccaatttcgcatatgccaaaaaagctgcaataaaaaataagatccagcttgtaatgataacaacaactgtagattttctaagcttcacgcacatccctccaatccacctacagcaaatttacagtatattataccttatcgagcgaagcgagtccagtccgaaggactatgttattgtattaacgacgtttgatagaatcaaggaaatgtggtacactttgtgtaaaaaataaaagcaaagataaaactacccaaaccgttggaatataattataaaggaaggtatcgaaacacatgaaaatccaaatgatctgtgtcggaaaaatcaaagaaacatatttaagagaactgatcgatcattacacaaagatcatccgtaaaaaatataattttgaaatcatagaactccctgatgagaaaactccagataatgccagtgacaaagaggagtcaaagattaaagaaattgaaggtcaaagaattcttgataagattccagaaggatctttcgtaattcctctctgtatagaaggaactccttactccaccgaacaattccagaagaaatgggatcagtggaacaaggagtccataaacaatatcacatttattattggtggctccctcggattatcaccaaaggttgtatccaaaggaaaattaaaattaagtttcagtagaatgacattcccacatcaactaatgcggttaattctaattgagcagttaagttatctttaatccaaagcattttcgaacattcggtaaatttccggatgttctttttttacgttgatcggttttaaatcttttgtcaccataccatgtgttgtttttccagtagcgatcaggtccccatctcttgtaaccttataagagaattccagacgaaccggagacagctttgtaagacttgcatgaatctgtaactggtcttcatagaaagctgcttttttgtatttacattcaagactcgttaatggagtgatgattccttctttttctacatctgtataagaaatgccagcagccttgataaaatcagttctggcaacttcaaaccagacggcatagttgctgtgatgagcaattcccatctgatctgtttctgcataacgaacttcaacggttgatatatgtcccataaattttattctccttttttcttttttttattgtaagcgtttctttacaatctgtcaaaatttagttaatttttttcctgattttccgatcaactggtaataaagaataaaagctattacagctgtaatgatttcagcaatccagaaagcatgccatacaccatgcactccaactgttttgcttaatacaaatgcagcaggaatgatcactacaacataacgtaaaaatgaaatcagaaaagactggataccttttcctaacgcttcaaacgcacctgcagaaacaacagaaacggaagaagctataaatcctgcacaaataatacgaagagcgatcgcaccttctgtcaatgtttcaggattgtttgtaaacatactcatcagtgtctgtggcaccacaaaacaaataaccgttccaacagccatgattccaacaacgatctcaaacgtcataagataaatcttgcggacacgagctgattcctttgctccataattataactcatgatcggacgcattccctggatcattccatttgctgttagatataagaatgtttgtaatttgtaataaacaccaagtacaacaacatatgtttgtgaaaatgatgctaagatcgcatttaaagcagatactaagaaagatggcagtgccatatttaaagttgccggaattccgattgcatataagcgcttaacgtaaacagcttccagctttaagtaatcttttctgattttcacatgaattgggcgtaatacataaacaagaagataaatgatcagtgtactgctttgaccgatacctgttgcaagtgctgcaccctgaattccaagtttgggaaagaatccgattccaaagatcaaaagcgggtctaatatgatatttacaatacagccagtcattaaagagagcatagtgattaccatatttccaactgcctgaaaaatcttttcaaaagaaatacttaccataatgattgttgaaaacattaatataattgttgaatattgtaatcccatcccaataacagtttgatcattcgtaaacattgcaagaaatgatggcatgatcattaatccaacgatcgtaagcagaattccatgaatgacatttaaaaacaatccctgagttgcagctttattggcttcctttgcttttcctgcaccaagaaacattgcaatgactgcattaattccaacaccgaatccaactgcaattgagttgatcagattttgtactggatatacaagggataatgcggtcattgcatcttcgctgatcttggcaacgaaaatactgtcaatgatgttatacaatgagtttacaaacattgagattaccattggcagagccattgatagtaataatggtaaaattggtttttctttcatatacatctgatccataaaatgattcctccttaataacaaaaaaagagacgatagaccttgctgtttaataatcagaaacagtaaaatctatagtctcttataagacgatattaaattgtattcgttgattttatctagataaagcatgcaccaggcgggagtcgaacccgcggccaacagcttcggaggctgccactctatccactgagttactggtacacaagctatattatattacaataaatatgatgatttttcaagaaatatttttatttttggtaattttattaaattcatgttatcataaaaagaaaacaacgaggtaactaacaatgattgacatccgaaaatttgaaccagatgatacagatgcagcagtcaagatctggaacgaagttgttgacgacggcgttgcctttcctcagttagatgacttagatcatgaaagtggtcttgctttctttgaagaacagacatataccgggatcgctgttgattctgatacaaatgaaattgtcggactttatattttacatccaaataatgttggaagatgcggccatatctgtaatgcaagttatgcggtctcttctgctcacagaggaaaacagattggtgaattccttgtcactgactgtataaaacgcgctcctgaatttgattttaagattcttcagtttaatgcagttgttgcaagtaataaggcagctttacatctatacaaaaaacttggatttatccagcttggcatcattccaaaaggatttttattaaaagatggcacttatgaagatatcattcctcattatctaactttgatccattcttgatcttcttttttctcaaagctgccatccccgattcccaatgcagattttgctaacatatcagcataatcattatatttatcattagaatgtcctttcactttcacgaacttgatctgcacatactgtttcatttcttcataaattcgttgatacgcctgtgttccttcttttttcgctgcccattctcctgtgcaccatttctggattccttcataatcataatgaatcgccagctttttatagccattttcttttgcaaaacgcatggccgcttcagaacctttgatctcgcctgctacattgcgcatggttgctaattctttatccgcataaggatatgcaaaataacgttctaccccatcatgcattaataccataccataagaaaatctcttctgagaatgatcataacttccatcaacatatgcaactaatgtatcttcatcaatctgcatcaattcatttgcatctggatttaagaacgcttctgcttctgcctttgtcttaaatcctttgtatcttgcatttgggaatcccatgacctgtgctttacatgcatcccatgacatatagattcctggttttcttcctttttttactgcgtaaaattttcctgccatatatttcctcttatttctttaatagtcttaatccttatattataattttctttgaaaagaaaaaatcctgcattgcaggattttccctaaccttatgattctagtcgttatctcttccaccaaataaaatgatcagacgaagcaagctcagaagtgctgatgctgcacctgctacatatgtcagtgcagctgctgataaaaccttccttgtctgccccacttcatcttcgtacatgatccctgtacttccaagaattcgtaacgctcttgaagaggcattaaattccaccggaagtgttactaattgaaagatcaccgctaatgaaaataataaaattccaacattcaataatgtctgattcattccaaggatcactccacctagaataaacaaccaggaaagattggatccaagattcacagctggaaccatagccccacggatcttcaatggtgcatatccttgctgatgctgtacagcgtgcccacactcatgagctgcaacaccgatcgctgcgatcgaatcagatccataagttgcatctgataatcttaatactttattctttggatcataatgatctgtaagattcccgctgacacgttctaccgaaacatcgtaaattcctgcctggtttaaaatacgttcagcagcctgagaacccgtcagtccgcaatgacaacggactcttgaatatcttcgaaacgttgaattcatcttggaagatgcgatcatcgtgatgatcactccgatgatgatcaaaatatacgttgggtcaaaataataaccataaccgtatggatacataaatatctcccttctttctctgtaacatgtagatgattatatcgttcctcctacatgaaatcaaggcagtttagaaatattttataatcattttattgaatgattaattcttcatatttttataacaaagaagctcttaattcgtctccggatttcgcactcaaatatgctggcgcaatatcaaatacagtcttacatccactctgtccttctttggaaagtttatatgcagctcttgcatatgcaactaaaacacttgatgtaaattctggattagaatctaattttaagctgtactcgatgatatgtttgttttctttttcccatcctgtacatccacttcttaatacaaatccaccatgagggatcttgctgtggtcacgatctaattcttcctgactgatgaaatgtacagttgtatcatagtctgagaagtagttcggcattgtcttgatctcttcttcaactttcttcgcatctgcaccttcttcaagtactacaaagcattctcttgtatgcttctgtcttgttgtaagttctggatcttccccattacgaactgcttctaaagctgcttctacaggaattgtgtactgtttaccatctttgacaccttccacacgacggatcgcatcagagtgtccctggctgactccttttccccagaatgtataatcttttccttctggaaggatcgcgtttgcatacattctatttaaagagaacattcctggatcccaacctacagagatgattccaatatgtccatattctttcgctgctttatctacatttgcaaaatgttctggaattcttgcgtgtgtatcaaagctgtctaccacgttaaataatttggcatattctggtgtctgaacaggaaggtctgttgcacttcctccacataacattaaaacatcgatcttatctttccaatcttctacatctttgacattacatacagctgcaccttctgttaaaatgctgactgtcgctggatctcttcttgtaaatacagctacaagctccaaatcgtcattctgtttgatcgcgcattcaattccgcgtccaaggttaccataacccataataccaattctaatcattgattttctcctttttgactttattaaacatagtatatcatttctgtgttttgcgttcaatgtattctttttatgatttttttgctataatgatcttaaaaattcccgatgattcctgatccttcgggaatattctaacagaaatgaggaattttatcatgtcatttaccggcattttcaaagcaaaaaacggcattgtcgctgtcgttgattcaaaggcatccagagtagaaaacgggcaatcttatgaagacgttcacaggaatccagaaaagctctttgtattccaaaacggaattgcaacaacttttggtgctaaccaaattttagtccagaatccttttgaattttcctcaaaagtcattgccatcgaagatctggtttatgaatatctgcatttaaagaatatcttagatgcttctttcttccaatctctgcttgtaaaaatgacatccaacccagccaatacagaacctgtaaactttctggttggacgcaaaatccgtcaagaagaatacatcttagaacatcatcaagtacgttattgtgcctacgcacaacggctcgcaaccccaatggaacatttctttactggaggagatgaaaaatatcgggaacactttgataaccttccatatctttcacagattacctctgttgatgtattgcagaaaactgttgcaaaagaattggatggattgattcaatattatgaccagcaatccgaatataatcctgtaggaaagcctgtgaaatcttatgttttaagataatgctactttatagttttatcttcgaaaaagcctccgcaaatgcattattgatcggcgcctgtgcttctttttgctgttttttcaaatatcggttcacttcttttttactcattccagaaccttgtttttcttttctttgtttaaatgcagacagtttttctttatacccacaaacacatacaaacttctgtccttcaccttctccgaccatttccatcttcttgtggcatacaggacatctggcgtttgtgacttttgagatcgtctttttatatccacagatacggtcctgacatactagacgttttccgtgttttccattgacttccaataaaaattttccacattccgggcagcggtgtcttgtaacattatcatgtctaaatttaccatccgatgttttaatatcattgatcaatgtctgtgtatagtctgagatttctctcataaatttctgatcattttgttttcctttagaaattgctgtcagtttcttctcccagtcagcggttaattctgctttcttaagatcttccggaactagttctaataactgctttcctttggatgtgatataaatttcatttccttttttctcaagaagatagctgttaaataatttatcaatgatatcggctcttgtcgcaaccgttccaagtccttttttatccatctgatcgatcaatgttccttctgtgtaacgccctggtggattcgttgttccttctgtcatggaaatcgttccaaccggatattcttttcctttgactgggatatttcctgctttgatcgtgtcttttgtttgagtttcctcttcgtagagttctctccatccaagctgtttgatattctctgcttttgcacggaaaagttctccatttatgcttgctttcacagagagttgttcagaaattgctggtgctgataaaacagctaaaaatcttgcaacaaccatatcatagatttttcgttcatcggaactaaaacttgtcaatgatgcatactgctctgttggaatgatcgcatgatggtcagatacttttttatcattgataaaacggctgcttgctttgatttcttttcttaataacgttgctgctgcctttttatatgatccattctgacatgctttgatcctgtcttttaatgtgtctgtcatgtcattggtcaaatatctggaatctgttcttggatatgtcaatactttgtgatgctcataaagactctgcatgatatttaatgtctgttttggtgaaaagccgtaacgtttactcgcttctttctgcaaagttgtcagatcataaagttctggagcatagttctttttctctttttttgaaacctccgtgatcacaagatcatgacctcttaatttcttaccaagttcctctgcccatttcttgtcagaaattctctgatttcctttctgattctcccatgtgaaattcattcctgttgcaaaaatcttataaccgtaatatttctgcggtttgaaactcttaatttcctgctctcggttcatgatcattgccaaagttggggtctgcacacgcccacaagataactgagcattgtatttacatgtcaaagctcttgtcgcattgatcccgactaaccagtctgcttcagctcttgatcttgctgcacggaagagatcatcatattcttttcccggttttaaatgtgcaaaaccatctttgatcgctttgtctgttaccgaagatatccacaaacggtagattggtttcttatttccagacatctgtaagatccatctggcaactaattctccttctcttcctgcatcggttgcaatgatcacatctttgatatcatttcgaaggagtaatttctttactgtctggaattgtttggatgtcttctttaacactgttaatttccagtgttttggcatcattggaaggacatccatattccactctttgtattcctttccatactgctcaggatccgccagagatactaaatgccctaatgcccacgttacaatatgatcatttccttcaatataactatgcgtttctttcttacagccaagaactctcgcaatatcacgcccaaccgaaggcttttctgctaatactaatcgtttcatttttttatttaaacctttctaaaattgtcatctcaaatttattatctcgaccattttaacatattttgtggtatactggaataaagatattttatcgtatttttacagaattgaggtatttacatatgaaattaatgatcgcatccgatattcatggatctgctttttactgtaaacaattaatcgaagcatataaacaagaacagcctgataaactacttcttttaggagatttactttatcatggcccaagaaatgaccttcctaaagattacgcaccaaaacaagtcatcgaaatgctaaacgctatcagcgaccaattgatctgtgtcagaggaaactgcgaagccgaagtcgaccagatggtactaaacttccctgttctaagcgaatcctgcatcctatacatcgatggacaaaccatctacgcaacccacgggcacataaactctccagcaaatcctccaaaattacataaaggagatattctgttgactggccatacccatatcccagcctgggaagaatatgataactttttatatttaaatccaggatctgtgtccatcccaaaagaaggatccgaacatgggtatatgatttacgaagataaaaagtttttatggaaaaccttaaaaggtgacgtatatcatacactttaatttttttgttttcttatcacatatcttaatggtattctataaccttcatgtatataaaacaaataaaaaagagatggaatacgaaaacgattgaatttcatggcggatcagcgttttgcaaaaaatccgtcatgaaattcatgtttcgtattccatctcttttttatttgttttatatactagaagattatatagtatcatttggatttcccatataaattcatcctctatttctttcttaacccttaatgatatcatcgatcgtgtcaaatgggattccctcattttccccgttgtctttatgcacatgtacaatatcatcttcttctaagcatcttgcaaattcaatctgcataaaaatacctttgatctctcttccatttaatgtctttacgatcacatgatcattttgtgaaacaaaaagttcttcctcattcccagcttcatcttgttttaccaatttcactcctggtaatacatttgtaaattccataaaagttgctcctttatcttataatttcagaaaaaatttcatcaattgtcctttagctttgttatatggcatataacgaactggaatatcaatcttatctgatttctttatgatactcttttcatgcgtaaatatatcaaaacttttctttccatgataagaccccattccgctattcccaactcctccaaatcctagatatggagttgcaaggtggatgatcgtatcattgatacagccaccgccaaaagacaactgtgaaagtacatcttgttctactttatcattttctgtaaataaatacaatgccaaaggtttgttatgatctctgatatacgaaactgcatcttctaatttgtcatatgtcattataggaagtaatggaccaaaaatctcttcctgcatcaccgtggattcttcttttacattcacaagtatcgttggggcgatctttcgaagtcttatatctccataaccgccttcaacgatcttttcatgtttcatcaattccataatgcgctgataatgtctcggatttatcatagatgaataatctttattcgacaaaggatgttccccgatcattttattgatccagtattttaagtagaagatcagttcactttctgcttttttatctacgaaaatgtaatctggagcaacacaggtctgcccactgtttaaaaattttccaaaaacaattcgttttgctgccaacttaatattggcactttcttctacaatgcatggactttttccacctaattccaaagtcactggtgttaaatgtctcgatgctttttccatcacgatctttccaactcgttctccaccagtatagaaaatatgatcaaatgactgttccagaagtttttcactgatttctactcctccattgatcacagcaacgtaatgagaagggaaaacttctccaatcatcttctttaaaagactggcacaatgtggtgcgtgttcagatggttttaaaacacaacaatttcctgctgcaatcgctccgatcaacggctgtaaggataaaagaattggataattccatggggctatgatcaatacctttccgagtggttctttgatcttataactttgggatggaaactgggcaagcggtgtttttacctgctctgttttcatccatttttttagatgcttctttgcataagaaagttcactttttaccatgccaatctctgccatataggactcaaaagatgatttccctaaatctttgtataatgcatgttccatatcttcttcatgttgtttgatcgcacattccaagcgcaataatgctttctttcgaaattcgtatttctttgtcttctggctttgaaaaaaatgttcttgtctttttaacatttgattgatttccatgataacttatcctttctttctctaccttcaccgcgttttatcttaattttaccatatatagtaaactaccgcctctcttttttatttattgccactttttaagaaattcgctataataaatttgttttacaacaaccatatctttacaatgaaaggatttatacatatatgaaacgtaatatcagattaacaattgaatatgatggttcccgctatcagggctggcagaggcttggtggtgattccaatgcgaatacgattcaaggaaaattagagtctgttttatcaaaaatgactggagaagatgtcaatatcaatggatctggccgtaccgatgctggtgttcacgcttatggtcaggttgccaatttccatacagactgtatgatgtctgttaatgagatcaaagactatcttaccaaatatcttccatctgatatcggtattgtggaagtttctgaagcttccgaacgttttcacagtcgtttaaatgcgaaagagaaaacttatctttaccgaattgcaattcctggtgtatcgaatgtttttgaacgtaaatacctttggtatttcccggaaactttggatatcaaaaagatggaagaagctgcatcattactgatcggaacgcatgattttaaaggattttcttcaattaagaaaacgaaaaaatctaccgtccgtagtatctataacatcgagatcaaaaagacaaaaaaagaaatccagatctcttatacaggaaatggcttccttcataacatggtccggattcttactggaactttagtagaagttggatgtggaaaaataaaaccagaggatattacaaaagcactggaaagtacaaaaagaagcgatgcagggattactgcaccgcctcaagggttatttctggtttctgtggggtattaagatctaatcttattctccccagacttcctcagcaatttctttcactaattttagttttgcccactgttcttcttctgttaatttattaccgatcgcacaagaagcaaatccacactgtgggcttaggcatagtctttccaaaggaatgtattttgctgcctgtctgattctgttgatcactttttctttgtcttcaagatctggtttctttgtcgtaatcagaccaaggacaactttcttgtcttctgatactttcttaagtggtgcaaatcctccagatctttcatcatcatattcaaggaaaagtgcatcaacattttcttttgcaaatacatagtctgcaactgtatcatatggaccacttgtgaagaatgtagaatgataatttccacgacagatatgggatgtaattaccatatcttctggtcttccttctaatgcaaggttgttcacagtaagcagctgtttcttcacatcttcaagatcaattcctaatgctttatatctttgtttcgcagcatctcccacgatcgctccccaagtacagtcatctaactgaagattacggcatcctgccttatagaactgtttgatcacatcctgatatgcaacaccaatatcctgaatcaattcttcatttgtcgcataatattttcttgtcgtttcaatgtttgttggaacgatcatttgctgaaacatctgtgctggtgcaggaattgtatattttgcaattgtattttcatcttcaaactgttttaaatatctgaaatactctacaaatggatgctttttcgctttgacctttcctatcagataagtgtcttctaaagaagctaattctccatcgaactgtactccacttcctgtctgttcatgtgctaccccttcaaatccccacataaaatctaaatgccagtaagttcttctgaattctccgtccgtgatcacatgatatcctaattctttttgttttgctactaattttgcgatctcttcatttacgatgttatcgtatacttcttttgtgattttgttttcgttatattgtgttgttgctttctttaattcttctgttcttaaaaagcttcctacataatcatatcgaaatggctcttgtaatttactcattttctgtcgtctcctttttgccttgttttttaagttgtatatagtatatcatttcaacatcatcttttaaaatatatatatttagcggtttgccatagttttaagttatagcaatggagtacctaggcagtgttaaagtaaattacattttatacaggatatgcttcttcatttccttctgtaacatcaattttcttctcctgtgcatcgcgatatttaaaatactctgtagcaacctgagggaataaagcgtaacttaatacatcttcatcctgttctttataagctgctacctccttttcaaattcaggaagttcgtcttcgatcatgtctgcatatcggcatgtaattggctgtttatctccaatacattttttctgtacttcgggattgaatggtttagctgttgctccgtatttcccctcaaggatttctttggtttcttttgttaccatcttgtagcgttcaccagtcacaacgttaaatacagcctgtgttccaacaatctgagaggatggagtaacgagtgggcattctcccaagtcttttcttacttttggtacttcttctagtacttcgtagtatttatcagatgcatgctggctttctaactgggatgtcaggttagagagcattcctcctggtacctgatagagcagggtcttgatattgactcctaagttctttggatttaataatccagaatctaaggcttcatctctgatcggacggaaatagtctgcgatctcggctaataatttctggtctaagcctgtgtcgtatggtgtatttttgaatgtttctaccataacttctgttgctggctgggatgttcccatggaaaatggtgacatagctgtatcaatgacatcaactccggcttctactgctttcatgtatgtcatagatgctactccggatgtatagtgtgtatgtaactggattggaatatcaaccgttgcttttagttcttttaccagttcttctgctttgtatggtaataataatccagccatatctttgatacagatagagtttgctcccatatcttcgattccttttgcaaggtctttccagtaatctaaggtataggcatctcccaatgtatatgacattgcgacctgggcatgtcctttttctttgtttgctgcatttactgccgtctgtaaatttcgaagatcgttcatacagtcaaagatacgaatgatatcgattccatttgcaatggatttctgtacaaaatattcaacaacatcatctgcgtatggacggtatcctaagatattctgtcctctgaataacatttgtaattttgtatttttaaatccatctctgaattttcttagtctgtcccatggatcttcttttaagaaacgcagggatgcatcgaaggttgctccaccccagcattccacagaatggtatccgacctgatccattttgttgatgatcggtaacatctgttctgtcgtcattcttgtggcaatcagggactgatgtgcatctcttaagattgtttctgttattttaattggttttaccataatattttcctccttacactccaaagattgccataaatgtacctgctgcaacggctgttccgatgactcctgctacatttggccccattgcatgcattaataagaaattcgttgggtccgcttctgctccgactttttgtgatactctggctgccattggcactgcggatactcctgcagaaccgatcagtggattgatctttccaccagataatttacacatcagttttccaaataagactcctcctgcggttcctactgcgaatgcaaccagtcctaataatacgatcttaagtgttgcgatatttaagaagttttctgcacttgtggatgctccaacagatgttccaagtaaaatgacaacgatatacatcaaagcattggatgcagtttctgataactgtttgactactccactttcacggaataagtttccaagcattaacataccaacgagcggtgctgttgttggaaggatcaggcagacaacgattgtgataatgattgggaacagtatcttttctgtctttgatactggacgtaactgttccatcttgatttttctctcttcttccgttgtcaataatttcatgattggcggctgaatgatcggtactagtgacatataggaatatgctgctactgcaatcggtcccataagtcctgtctgatgtaactttcctgcaaggaaaatggaagttggtccgtccgctccaccgatgattgagatcgctgccgctgcttttccattaaatcctaagaaaattgctaagaaatatgcactatagattccaagctgtgctgctgctcctaataagaaactctttggattagcgatcagtggaccaaagtctgtcatagctccaacaccaaggaagatcaatgatggaagaatactccattcatctaaagtataaaagtagtgtaataatccacctacaccgtttgatgtacttgctggatctgccatgatatccgggtagatattaacaagtaacattccaaatgcgatcggtactaataacaatggctcgaatccatgacggatcgcaagatataaaaataccagtgcgactaagatcatgacatagttcccccatgtcagatgaaaaaatgctgtagagtggatcagattcgataaagtatgtgtgatattagccatcaaatcccctccattctaattcattgtagctaagacagctccattttcaacattatttccctgtgatacagcgatacttgcaattgttccatcctgaggtgcaacgactggaatctccattttcatagattctaagatcacaaccgtatctccagctttcactgcctgtccttgtgatacttcaactgcaatgatctttcctggaacagaagatttaatctcaacacttcctgcatttgatactggatgtgttgcagttgctgcttcatttcctgttgtttcttccactgttacatcgtatacatttccatttactgtaatcctataacttttcattttctctcctcctgatctaccattgatttctgtgtactttttttatcgaacgaacaatatattgtcttggatcttttccttcagaagctgcgatcgctgctgtgatcactgcaattagttccagatcatcaacgagttctttttctactggtacctctacaggtacttcttgctttaccggttctgctatcttctttttcgtcaatttttcttccaacattggaataaaacgaaataagtaaatgagaaaacttaatgaaaccagtacaaaaaatacaatggatacacccatgatcgtattacttactgctgtctgcataggttccctccttctttaaaatacagaatgtttttttggtatctgcatttctctttttgtatacagcatttcaaaagcaccaatgacatattttcttgtttctgccggatcgatcactgtgtcaacatatccacgtcttgctgctgtataaacatctgactgtaattcttcatattcctttgctttttcttttagtacatctgcatttgctcctggatacatgatcttgacagccatatctgcttccatcattccaatctttgcatcactccatgcatatacgaagtctgctccaattgatttactgttcatagatacataggcacttccaaatgctttctttgagatcacattcacttttggaactgttgcctgtacaaacgctcctgtcattgctccgattgcctgtgaaagttctttttcctgttcgatttcggctacaaatccaacggtatctgtaactgtcaaaattccaatgccaaacgcatcgcataatttcacaaaggatgctgcttttttcgctccctgtgcgctgattctttcttccttattggcaatacatccgattgtttctccatccaggcggataaatccgatcgtcatatcatttccatagtctttctttaattctaaaaattcattctgatctgcaatctgtatcaagatttcctttccatttcctgctgaaatattttcacagagacgattcaggtcatctacacaatctatgaccttgctttgatctttgtagtttgatgggaagatttgggttaactttcggatctcttcgaaaacttctgtttcatttccaacaaaatctaccgttcctgcttctttgctctggaagactgcacttgcactgtttaatacttctttcctgtttccttcgatcgcatttggtgcatttacaaacaactgtccattttctttcattaatgtaaaatctgttaacgttggaaatacagaaagaccacccccgcaatttccaaagattgcactgatctgtaagatcactccagatgcctctgcctgtttcttatagatcattccaaatgcatgaagtgcatccgttgattcctgcagacggattcctgcacaatcgatcatcccgatgactggaactcctgtcttgatcgcaaggtcataaagatttacgatctttcttgcatgcatttctccgatggaaccaccaagtacctgggcatcctgactgtatacataaactgggcatccattgattagtccatatcctgttacaaccccatccgatggagtctctactttgtctaactgaaagtctgtacttcttgctgttaccgcctgtccgatttctacaaaacttctctcatcaagcaatgcataaatcctttcaactgctttcccttttgatttattttccataaagacctccttttcttgttcttttgtatcttaattctatcgtggcatttcatcggaatttcctatgatataaagttaaaaaagtgtcttcgacacttcaactcccctgcccctcattcttgaggggtgggtttctttttttgtctttttccttcataatagaatcatgaatatcctacaagagatctttacagatcattatgaagaaatcaaatatactcttcatcccagacctgctgagatggaaaatatcgataagatgatcaactgtggtgatccttcttatggtggtgccatgtatggctgtatccactgcggaaatctcaagtttgttcctttccgttgtcacagccgtttctgccctacctgcggtaataaatattccatggatcgcactacctctatgtcctttaagctcgttaatgtcagacaccgtcattgcgtttttaccattgatgcgtccctccgtgattttttcctgcaggatcgctctctccttaactgtctctttcattccgtctccagtgttgtccttcgcttattctctaaaatgaacaaacacaaaaactttacccctggttttatcatggtcctgcatactttcggcagggatcttaaatggaatcctcatatccattgtctcatctctgaaggcggttacagtgatgatgctttctggcgtaatgtctctcatttcaactatactttccttcgcaatgctttccgtactgctctcctcaaggaaatgttgctccgcatcggtccttcttttaaaaaagtttctgcccgttgttatctggaacatgaacacggcttctatgtttatgccaaacccaaccgttgtgaccctaagactgttaccaaatatattggccggtatcttggtcgccctgtcattgccacttccagggtcgattcttataccggtgatcttgtctctttccattacaatcgtcacgaagatgatcaatacgttcaagaaaccattcctgtcatggattttatcaaacgccttatccggcacatccctgaaaaacatttcaagatgatccgttatggcggcctttatgccagacatcgttccattgataaaaaactccatctcgctatttcgaaagaaaaacggcatactttccgttgttttaaccggtggcgtactgcgatcctttcttcttttggctatgatcctctgatctgtcctcattgtaaacaacagatggtgatcctagaaatatatcataaccatcgccgcgtacctcttgaagaattatacgagaaagcaatgtcccgctcccgtggaaagcgttcttctgcatgaccacttctttttatgctataatcctcatataaaggaggaaccctaccatgaaaaagaatatcaaagagctacgcgaaaaatatatttcaaatcccccaaaaggtatgacatccgaggacattcgccatatgagcgaggatgacctgctggatatggattattttctaaatgaagatgtgtttagtgatgattttggtgaagaaggtttttatattttctaaaaccatgatcatctgtttgctctgcccacttttatgtgggctatttttcttttggaaaggagccaaaggcgaactttcctataaagtaaaaaagggcctgcctatcctacggataggcaggcccttttgtcatgctttactttaaaaatatatgatctaaaattaaaataatccttcttcattaaaataatcgattctcatcgcatgtcgcacatctttcattgtttcctgtgcttttgcccttgcagcttttgttccctgctgaagaatttctgcaacttctggaagttttgcttcccacatctttcttctctcgcggattggttctaattctgcctgaagtactttgtttaagaacttcttcactttgacatctccaagtcctccacgctgataatgggcttttaattcatctaagttattgtattctggccagaattcttcaaagtattctggtttacagaacgcatctaagtagataaatactggattaccttctacctgtcctggatcttcaacccttaaatgatttggatctgtaaacatggacattactttcttcttgatatcctgtggttcatcagataagtaaatacagtttccaagagatttactcatcttcgcttttccgtcgattcctggaagtcttaaacatgcctgattgtctggcaatacgatctgtgggtctgttaatgtctctccatatacagagttaaacttgtgtacaatctctttgcactgctctaccattggcatctgatcttctcctgctggtacgaccgttgctctaaatgcagtgatatctgctgcctgactgatcggatatgtgaaaaatccaaccggaatgcttgcttcaaaattcttctgtttgatctctgcttttactgttgggttacgctgcactcttgcaactgtaactaagttcatatagtagaaagacagttctgtaagttctggtaccatagactgaataaagatattgactttctctggatctaacccacatgcaagataatcaagtgctacctgcataatgttctgtcttactttctctggatgttctgcattatctgttaatgcctgggcatcagcgatcatgatataaatttcgtcgaatttaccagaattctgcagtctcactcgttcttttaaagatcctacataatgtccaacatgcagtcgtcccgttggtctgtctcctgttaatattacctgtttcattattttctccttttccgctttccgtatagactttgtacgtcttctcttatgatctatactcttatgttttattgtaaaatcaaatgcgtaaagtgtcaatatttcattgtgaaaagatttttgcgtgtccgcactagaaagacattcatttctgtaaaaaagacattttgtattgacttaaggaacaaaagtaaatataatagatgagattgattctttatttttaagaaaatatgatgtaagtatcaaaatatcacttaaaaataaaaaaataatgaaagaaggaatttttaaaatgaaaaacttattacaaaagtggaatagcttaagtctgatcgtaagaatcttaatcggtctgatcatcggtgctattcttggtgtagctgctccaaaagcaacagggcttgctctacttggagatttatttgttggtgctcttcgtgctgtagccccaatccttgtatttgtacttgtcattgcttctttagcaaattctaagagcaacggtgcaaaaaatatgcgtattgttatcatcctttatatgctaacaacttttattggtgctgttgtcgcagtatgtggaagttttctcttcccaatcacattacgtcttggaaaagctgctacatctgaagccgctcctccaacgggtgtgttagaagtattaaagaacttattaatgaatatcgtatcaaaccctgttgattcccttgtaaaggcaaactacatcggtatccttgcatgggctgttgtttttggacttgcattaaaagctgcaactcctggaactaaaaaagctcttcatgatatctctgctgcagttacaaaagctgtacactggatcatcaactgtgctccatttggtattcttggacttgtatataacactgtatctacaaacggattaagcatctttactgattatggtaaacttcttgccctattagttggatgtatgttatttactgtatttgtaacaaacccaatcatcgtatttagtatgcttcgcagaaacccatatccactgatcttaaaatgcttaaaagaaagtggtttaacagcattctttacaagaagttctgctgcaaacattcctatgaacatggctctttgcgaaaaactgggattaaatgaagataactattctgtatctatccctcttggttctacgatcaacatggatggtgctgcgatcacgatcacagttatgtctcttgcagctgctcatacaatgggtatctctgttgatattcctacagcgatcatcttaagtgtcttagctgctgtttctgcatgtggtgcttctggtgttgctggtggatccctgctgttgatccctcttgcatgttctttatttggtatctcaaatgatgttgccatgcaggttgttggtgttggattcatcattggagtagtacaggattctgttgaaacttgcttaaattcttcttctgatgtattacttacagctactgctgagttatatcagagaagaaaagctggggaagatattgtattgatccctaataaataaaaacttatgaataaataaaatttgtggaaatatataaaaaatagattgtttcccttggacccactctcgttcagattcgcacgtagcggacactaaattcgacagcgacgatgaatcgtcactgctcattaagtgccgacgagctcatatggtccaagggaaacaatctattttttatatatttaaattttgtttattgataagctgtaggtatgagtgactgctcatgagtattggattttaactttagttttataataaaataaagattttaaatgcttgttctcattcccagggtacaatgttctaaaagtttttcactatttatgatttcaatttgtctccttgataagagaagctctcgccattgttacaagatctgctttgtctgcttgtaaaacactttctgcaatttcaacatcattgattcttcctactgcgatcactggaatatctaccacttttttgatctctgctgcattttctacatatgctgctcttggaacaacagatggtggaatgatcacgattcctcgatttctaatccacctgggacatattcaaccgctgacattctgtataaaactggataatcttttccgcatttttccttaatattctcaatgatctccattgcaaatcttgcacggtttcggatcgttcctccgtattcgtcacttctcttattggaaaatggagaggcaaatgctccaatcagatatccatgtgccccatgaacttcaactgcatcaaatccagcttcttttgctcttcttgcggaaggtccgattggctgttctcctgtgatcgcactgcttgtctctcttcctgcatgataaatctgtgctgcgatctttccacctgcttcatgaattcttcttgttaactccttatggctttcaatctgtccatcttcccataatccaggaagctttttaaatccacctgcagttggtgtcactgcataatcttctgtgatgatcagtccccatccaccttttgctttatgttcatgataggcaataaatttctctgttgccattccatcctcagaacaatagtttgttaccattgctgatacgaccatacggtttttaagctccatctgattgattttaaacggttcaaatactttcattttactgctgctccttcctttcatatccgctatccttttgataactttactatagtctgattcctggaattgttctccctcatatgagggagaaacgaaaaaaagtagttataccaaacatttttgtttcatacaactacttttgtttatattattcatttttctaataaattaaaattctttttttagcataattccttcagctattttcaatgacaggaaccaaatgacaatggaaattatatatatagaagcccatagtgtaatattttttaaatacatttgattcatcacgatgtcaatcagctcaatccctgccgtttcaaacattttgaaaaagaagataacaacaaaaacaatccctccgatcatagctgctaacgcgattcttcccttctctgcttcatattttaatagaaaaggaatggccattgattgaaaaatcaatagcattggaatattgagtaagactgtcatcacaatttcttctgacctcattaacaatgtaccttttgctgctgtaacgatgactactaacaatatacctccaatgactgttatcattccccaaaagaggctaaacagatatttttctcttgtatattcttttctgctaaatggaagcgtaaataaaaacgcattgccattatcaaatgtatcgtaactgatcgtactgattgctgtcatgattgtaatcacagacgtataggtaattgcaaatgatatttgatccgtagcgattaagattcctgctgcaactagccagatcactgccagatttttttgttgtgatgagattaatctgatgtcttttgtccataatcctttcatcttctacaccccctgtatcattaatgtaatgatctgatcgatcgttcctttttctaccacgatctttggataattctccagataaaattgtttctgatctgtaagacatgcatatccataggattctttcttcatttttattatatattgtggatctagtgtttttgactgttcttcatcaacctttaagatcgcataattacttaataaccggtctgtttcttcgtgcaagatgatatttccttcattgatcatataaatattatcacataaggtttcaagatctgttgatatatgagaacttacaagaatcgaacgttcttcatcttcttccatataatctcttaacatatcaagcatctcattccttgccatgacatcaagccctgccgttggttcatctaagattaatagttttgctttgtggcagattgctgtaattaactttaattttgctttcattccaacagaaaactgttctagttttttgtctgttggcaactgatatttctctatatagtttgtaaataactgttcatcaaatgcttcatatgtattttttagaatatccttgatgtcttttactgtaagatatctgctaaaaccagaatcagaaagtacaacaccgatctgttccttatcctctggttttatatccttgacattctttccaaaaatctgaatatctcctccatctatgtaaatcaatccaagcactgcctttaaagttgtgctttttccagatccattcggacctacaaacccagtgatcatcccctcttttacttccatggaacagttgagggtgaaattcttatattgtttctttaatttatcaatttttaacataccttatccctccaatattaactcaaacaaggttttgatatcttcatcactgatgccaaaacgccttccttttagaattgcttgttctaagtcctgttctacttccttcttttgctcttccatcatcaactccgtgttcgccgctgtcacatagctgccttttccatgaatcgttactgtaaagccttctctttccagttcatcgtaagctttctttaccgttaaagcactgatctttaattcctttgacaatgcccggacagatggcagctggtcattctgctttaattcttgctttcggatcattgttttgatctggtctatgatctgctcatagattggaaccatggatgatgtgttgattatgatcttcattttgtatcatcctcctttacttataaacagtgtataacagcatcaaactgttgtcaactgttatatggtgtttgttttaaaataaataaaaaatagagttattgcattatcataataaaagttcaaaaagaactatagataacgcaataactccatttttatgtttaaattttatataatttaataatattcttctacatatttatcagcaacttctttatccaaagaaaagtcctccatgatattttttattgtatcttctcttgatgcttccatcttcttataaattttaattgcaccctctactcttccttctatccttcctttctctcttcctctttcttctaattcttctaaggccttgcacatattcaactcaactccttcctgttctaatttcaatgaatcatcaattaatttctgcgtttctgtaattgaacctattaccattccaagttctggtgatattgttttttctttttattccatttttaattcattgtcgatataatttttaacaattcttgcaattaattgatactatcttcaaatatttataaaaacaaaaatagagattggagtacaaaataccatcaatggcattcatttttcatacttcaatctctatttctatttttatgaatattcaatacacttctgtattacaatctaatttttctcatccatcaatccaaactgtatcgtcacacaagtagcaatgatcaatccaaacatataaaatgaatattttaacacattaagtggtgacacatctgcgagtgccgtgatcattaacatacctccatcatgtggcatcaatgagataaatgcacaggcaaagatatctaccagactggcaagtctctttggtgcaatcttgtatttttcaccgatttcttttgcaatcggacaagtaacaataatagcaatcgtgttatttaccattgctgcagaaagaattcctgacatcagcccgattccatattctgcaccacgtctattcttgatcttgccactaatcgctcctaccagccactcaactccgccatattcgcgaacaataccaatgattccagataccaagatcgcaaccatactgatactaaacatatcactcataccatttccaattgcctgaatccagtcaaaaaatccgcagcttcccacacaaaatccgataatacctgcagagaggattcctacaaaaagtacaactgcaacgttaatccccatcaatgctgctccaagaacgataagatatggaaggacttcaatgatattgtaacttcctgccttgattgctccacttccagtacctccgaccactgaataaaggatcattgccacaatcgcagccggtaatgcgataaagaagttcatcttaaacttatctttcatctcagaaccgcatccttctgctgctgagatcgttgtatcagagatcatggaaaggttatctccaaaataagaacctccgatcactgctgctccaacgatcgcaacatttaagtgtgctccctgtgccacattgatcgcgattggtgccattgctgcaatggttcccatggatgttcctatcgatgtagaaataaaacagcacattaaaaatacacctggaatcaaaaatgttactggaatcacatgaagacatagattaacaacagaatcttttcctcccattgccgctgctgctccctgaaatccccctgccatcagatagatcaaaacgatcatcataactccagaatttcccatgtttgtcgtcataatgtttaatttatcttttacatccatacttctatttaaaagaagtgctaccgcacatcctgccaaaagtgcgacatgacgtggaaattttccaaatgggtcgtctgctcccatcaaggtaaatgtaattccacatcctacataacatactagaaatacgatcagtggaagaaaggccacagatcctagatttttcttttgtttctccatttcttttcctctcaatcttaatatatatccagataaatctgtcttatttctctgccagatgcttatccagtgcattttttaactgtgtcagtgcctgctcaaccgtcactcgtggacacgcaacgttgaaacgctcaaactgtgctgtctctggtccaaagatgattccagaatccagccacaattttgcttcttctaacattaaatgttctaattcttcattgctgaatccatatcctgagaaatcaacccatactaaataagtcccttctggttctaccatctttgcttttggaaagttctcttttacatatcggctcatatactttacgttttcatatatatattctaccaattcatctacccagtcagcaccttttgtgtaacatactttcacagcaagctgtcccattaagcttccctgactgtaagctgcctgtgtattagcccattgatatttttttcttaattcttcgtttggaataatgatatttgctggctgtaatcctgcaacattaaatgtctttcctggcgagctgtaaagtgcaatgatctcatgaaattttttatccagattcatacagcttgtaaactcatgtcctggaaaaataaaatcacaatgcatctcatcaaccatccagattacgttgtattttaaacagatttctgcgactttttccatttcttctcttgtccagactcttcctactggattgtgtgggttgcagaagatcagtgcttttacattttcttctttgatcatttgttccattttttcaaaatcaatagaataacaattgttttcataacgaagctgacagtttaccagttttcttccatcatttttgataacttcactaaatggatagtacactggctgcataaccatcatggcatctccttcttcggtaaatgccttaacacttgttccaagtgcataaacgattcctgctccaagtgttacccattctggtttgatcgtatatccgtatcttgttgaaaaccagtggttcattgcatcaaaatattcatctaagggatccgtatatccaaaaatcccatgatcaattcttttatgaaattcatcaagaatctcatctggcagacgaaaatccatatctgctacccaaagaggaagcaggtcatctcttccttttctcttcattccaaaatcgtatttcaaacaatctgttccatgtctgtcgattacttcgtcaaaattatattttcccattttctactcctgtgttgttttttctgtctttttatactggaacatataatatttcatttttaccaccacagatcatgccaagtgttgcactctgtgcattcgatagatcatattctttccttgtgatctctttcatcgatggtgcttcttccataacagttttttctaagtttcctccaccgatacttccaatgattctatcttttgtgacaagcatcatacttccaacacctcgtggagatgaaccagatttctttgtgataatgcatagcactcctgattcttttgtctcaaaaagttctttactcatcgtactttctgtttcgtgatttttgattgcgatcatctctgctgcgatactgattgcaatctcttctggcgttcttgcaccgatctttaatccgattggtgcatggatcgtgctgatctgttcttcactgtatccttcttctttcattatctcgaaggtttttgcaacttttcctttgcttccgatcattccaagatagagatatggccttcgtaataccgtttctgcacataatctgtcatttgcatgtccacgtgtgacaaccacataaaatgcgttatcttgttctggcaaaatatcttctatgtcatgaaaatctctgcagtaaacttcatctgcttgtgatagtttctctggatctgcaaattcctctctgtcatcgatcatgatcgtgtagaaatctaaaaatttcgcaatctggagtaactggatcgctacatgtccagccccgaagataactaatttgggctgaatcttaaaccaatcttccttgatctgtgcgacatctttttcttcctgtaaaaatcgagcgatcactctttgatacagtgtatctgcctgtcctggatatactttgatttttgtatctttatattgctctctcaatggtcctagatatcctttcttcagtaatttttgtaaatgcagcggtgtaaggatcgtatcttctttgatttctaaatcctgatccgctaaggaaagtctgtgaacaaccttgctggctggtttcccaagtgctgacattccgatcacaatatgaatctcatcgatattttcagggatcactggttcataatccgctggaatctttgccggcattcccctggaaccatcggcttctatcagcgtgatatctgcttcttttactgcagtttcatagaaatcttctggtaatggtccgattttttgtactaacgcattttctggcgtcgcaggcattcccgccatacaatatccggtttcatttaattgctttcgaatatcttctatattttcagagatcacggtatcggattcctttttcatatgagttgtcgttgtgacaaagactttctttccaagacttctataatactgtgctaacttatgaactctcgttgtttttccaccggaacctgcaactgcaatgatcatatctttttcctctttattcttctgcaagaatcttaactgcatttattatctggttgatttctttcattgttgtctcatgtccaaaactgaatcttaccattccctgctctatcgtaccgaaatgctcatgtaccaatggtgcacaatgagcacctgatcttgtctgtatctgaaaacgttccattaattcatcactgacacttccggaatcatattcttccaggttgatcgaacaaatggcggtttgttttgtcagatctaattgcttttcatggtaaattttaattccttggatcttctgaatttttttataaaatatttcaataagattcatttcctgttcacgtatcttatcaattccatatgtattgataaaatcaattgctgccccaagtcctacgattccgatcccatttaatgttcctgcttccaatgcctgtggcagcactcctggctgtgttttcgaaaatgataagattcctgttccacctgtttttaacggatggatttctacaccttttctaatacagatccccccgataccctgcggtcccatcaagcctttatgtccggtaaaacataatatatcgatattatcttccttcatggagattgggatcactccagcactttgagcggtatcaacgacaaataaaattcctttttctctacaaagttttccaacgctttggatatcaaacatttcacctgtcacattggatgcatgcgtcatcacgatcatcttggtatcttttgtgatcgcctgtttgatatcctccacatctggtgaagtgatcgttaagcaaactccttgtcgttccatctcatataatggacgaagaacgctgttgtgctccataaacgttgtgatcacatgatcgccatgatttaagcttcctttgatcactgtgtttaagctttctgtaattccactggtaaatacaacttgttctgctccatagccgtcaaaaaactgatctactttcgtacgaacttcgtaaatctttcttgcagcatccagggaactttcattgacacctcttccgctgttaccaagtgccaatgcgttcataactgcatccttgacacactctggtttcgtgatatgcgttgctgcataatctgcataaattgtttctaccttttgtttctcatggatacatataggaacattcggttctttctgctgatcagaaagattatttttcaaatataataatgcttccaaaacaccacctgcaatgcatctggctttatctgaaattgtaaagcagttatcgtattcttcagctctcggatcgatatctgcgatcttaaatccttttgtcaccggatatccatcacgaattaaacctctcagtaatccatccatacttgcaggtacatcaacaatcataccttctggtgtttctatctttgctaataactggcctttgcttaccatatctgtgatatgacagatatttcttaagatccctttagctggggaatggatcactcgttcttttccaaagcctttgatcactcctggaattcctgtgttcgggatcgcactgccttctttgatgatccttccaagcctgtgtccacgcatcgtctcgatcacaacatcgacatcttccccggctgtaaatccaggtcctaaagcaatcgtgatcggtgccatatctcttgttgtaccaagatttttcttcgcaagaatggcatcaacaactgcgatcggatgcaactgtttgatcatctctccttttggatcgatcattaatgccggattccctgctttcatgatctgttctgcttctttgatatcatgtgcaagatggcaggtcatatcctcaacctgccacttttcttcataaactgcttctgaaaatgcaacatttctacgaattgcagatggatgtgcaatttctaagatcaacacatgaaaaccactttttaccaatttataaattgtacctgtggcgatatctccaccgcctcttacaatgattaaatcttccatagatattcctcaaggtttgatcacttttcctgctttttccatcatttctacgatatcatacatatttgtgatggaaccaaccgctaatttatctgtaatatcatagaaatttaagcatgttccgcaagtatatatttcaactccttctgcttctaatgtttttaaatcttctaaagaatcagaatcttcgcatgtaagatatgctcctgaattataaaataatacctttgatggaagtttatcctgttttgttactgcaaataaaaacgctttgatcaatgtctgaccaagagctttctctccttgtcccatctcgttggatgatacagcgatgataaaatcatcctttgcagatggtgcacagacaatctcttcttcctcatctgccggtgtataattctctgccatgatctcaatcttaaattcattgtctgagatcttctcgcttttaacttcgcagtttttaccttctgcaaatcttgtaacattctggacagctggttcattatctaccagaacgattaattttgtctctccacccattgattctaatgctttctttgtgtgtacaaccggaatcggacaagcattccctctttcatcaatctgtttcatacttaacctcccatttaaatttctacctgaaataccccttgtgggatgatttcattttctgacataaattgtaccacagattcttcattttctaaaggggtcatccatgccattccacatcctgctgtgatctcttttggtactgggatcaatcttcctgcgatctgatgttttttgcaggcactttccataccgatcgcctgtgttgttgtctcaaatgtgatcactgtttttaattctttttttctcatgatattttatgattctcctgaatttccaaagttttttataaaagaacgttttactgcttcagcaacttctttctgaaagttttcataacgattcagaatatcttcaccttctggtgtaaggtgtgaacctcccccttgctttccgccggattttcgttctactaatttgactccaaggtctgcttccgcacgatttaagatcttccatgctttgcttgcagccattcccatggatttatatgcagcagataaagaacctttctctcttgttaatgataataactgtgcaactccttttccaaaatctggttcttccataaaaactctgaccctgaaatcaaaacgttttggtaaatatgatttcatgtctaccacccttttccgaatccacagtttggataagtacaaactttacatccaagacataatccgccttctccaaggtgtgcaagttcttctgcacttactttatcatctgccatgatccttggcagaataagatcaaaaacagttctctttgaatacataacacatcctggaagtcccataatcggaattatctgatctccttttttataatatgcaagtaaaaacattgctcctggcaaaaccggtgctccataagatatgatatcggctcctgtattcttgatcgcaagtggtgtcttgtcatctggatcaacactcattcctcctgtgcataataccatttctgccccattttcgatagcttctaagattgtttttgttaaaagttcattgtcatctggcaactgttttgtactggtcacttctgcaccgtattctttgatcttttctgccacaactggagtaaatgtatcctcaattctatgataatacacttcatttcccgtagctaagatcacggcttttttcttcttataaggcagaagagacaggattggtgtatccccaaccctgtctttgacttcctgcatcttatctttttcaatgaccagtggaatgattctcgtacctgctagtttgtcccctgctttgactggagtatttccagatcttgtcgcgatcatcatctgtccgaaagaattgacggtaaatagtttttctttgtcgatctttaagagtccgtcatattcggcagataattcaatcttaccttccttaacttctgactctttcattccttcattcttgcacagatcacaaaggatccttgctgcatcattttcatgaagcatatcatctccggcttcccagacgtataaatgatcttttccaagggataacaacactgggatatcttcttctttgactacatgacctttcctgaatcttgcgtcttttgtaacacctttgatgatctgtgtgatatcatgacatagcacagttcctacagcatcttttgtatccactaatttcattgtttttcaccttctacttcttatttattaattgtaaatccataagatctgaagacttttaatgctttttcactctgtaagaattttacgaatttatcagctgcatctttatttttacttttctttaatgctgcaactggataaataactggcgtttttaaagcatctgctggtgcttctgcaagaacttttacatccttgttacttgctgcatctgttgcatatacaacaccgcaagaagcacttccttttgctacccaatttaaaacttctgttacatttgttccaaaacttgcttttttcttcacatcattccagttctttaagtttgtaaagatttcttgtgcatactgtccggctggaacgctcttaggatctcctaatgctattgtatcagcttttgtaatatctttaaaggatgaaacttttgcatcaccttttttaggagcgatcagtacaactttgttttctaataattctacaacatccctcttgctgatgtatttttctttgacaagactattcatctgttcggtcgctgctgacataaatacatccgctgccattccattttcaatctggctctgtaattttcctgaactatcataacttccttctactttaattcctttattttctttttcaaacattggaattaatttctctgtatagcatttttcaagactagctgcagctgcaagtgtgatggttgttgtttcttctttctttgctgcctctgttgtggatttagaactgtccttactgcttccacatgctgttaccccaagaaccatagctcctgctaataatactgctaaaaatttctttttcatttgtaacttcctcgctttcttaaaaatgttatgtaagatttcatcgttaccttgttttataatgtggctttttccatatgacctctttggatatggtattttttgtcacatagattttctacttctttgctactgtgactgaccaagatcgctggtttatccaacattgcaagcatattggataattcatcttgcatctgttctcttaagtattcatccaacgctgaaaatggctcatccatcaagatgacttccggttcacacacaagcatccttgctaacgctgttcgctgtttttgccctcctgaaatctgtcttggatatctttttgctaattcttcgatatgaaatcgtttcatcatatcatttgtcttttgttcgatttcatccttcggaaatccttttgctcttaatcctattttgatattctcttcaatcgtcatattaggaaacagtgcatatccctgaaataaatatccaatctttcgtttttgtggtggcagatcgatctttttctcggaatcataaagtattttcccatctagtacaattctcccactatctgcagtttccacgcctgcgatacattttaaagtaatgctttttccacttccagaaggtcccataagccctgtacaacctgtttctacattaagttctgactctaatgtaaattcttttagtttctttttgatctttacttcaagactcatacatctctccttacgcttcctgtttcttcttttccatgatcaggtaaatattcatggctgctacgattgcaaaacaaatgatcacgatcacaagtacatactgatatgctgcatccatatttcccgctgcaacttcagagtatactgcaagtggcagagttcttgttcttcccggaatatttccagcgatcattgctgttgctccgaattcaccaagtcctctggcaaatgcaagcactccaccagaaatgatccctggcagtgcatttgggatcataactcgaaagaaaatgctccactcactcattccaagtgttcttgccgcaaagatcagatcttcatcaatctgttccagggcacctcttgcagaacggtacatcaatggaaatgacatcacaactgccgcaaggatcgttgcgccccatgaaaatgcaatcttgatcccaagataattttcaaataattttcctactggtccatatgatccgaaaaatacaagcaagaaaaaccctgcaacagttggtggtaatactaatggcatcgtaaagatcccatcccagaagattcttgttgcgtctgatttacgatataagatccatcttgctgctaatagtcctaaaataaaagtaaataaaatcgcgatcgttgccgttttcatcgatatgatgatcggtgatatatccatacattgtctcctctcttagtttcttccgcaatcttctgtgttttcccttaaagtatctaatccatgtggcagctgatcaatgataaaagaaagactctcttccactgcctttttgcttccaggaagattaatgatcaatgttttctttcttattacactgacacctcttgataacatagctcgttttgtgatcgtcatagaacctgctctgatcgcttctgagattcccggcacattgcggtctgcaacagctaaagttgcttctggtgtacgatctcttggagaaagccctgtcccaccggttgtaataattaaatcaacctgccggctgtcgcttaaacggatcagatgttttttgatctgagcttcttcatccggaagaaggatttcttctacgatcttaaatccatgttcttttaagatttctgctgctcttggaccgcttgtatccactcgttctcccctggagcctttatcactcaatgtcatgactgctgccatgtatggcatatctttctctgggtaaatgacctcaatcttatctccgactttgatcgttccgctttctaatacttttgcaaagataccttctcttggcatgatacagtccccaacacgtttatatatctcacaatgactatggcattctttcccaatctgagtgatctcaaactttgcatcattacagatcagttttgtcccaactggaagtttcttaaaatcaatgccgtaagcaagaatattttccccaaaatcaccctcgatcacggaagcacctttttcattgaattcatccacaatatccgcactcaaaaaactaacctgacgatgccattttcctgcatgggcatctccttctaatccaaagtctttgatcacattgacttcgttgatatttttctttacagttcctcgtttttcactgatacagactgcttttatgattccttccatacaaaatcaccactctttccacctgttttctctactaaatgtatctctgacataaccatatgtttgtcgattgccttgcacatatcataaatcgttaataaagcaatctgtactcctgtcagtgcctccatctcaacgcctgttttccctgttgttttgacaagacagactgctttgatctctttggtttcttctagcatttcaaaatcaactttacactttgtaagcatcagaagatggcacatcgggatcagttcaaatgtcttctttgctgccatgatccctgcgatccttgcagttcctaagacatctccttttgccatacttccttctttgacttttttaaagatctcatcattaactttaatctttccttgtgcgatcgctgttcttgttgtttcttttttcttcgtcacatcgaccatgaccgcattcccatgctggtcaaaatgtgaaaattctcccatttatcttatcctccaattgtatacatcttgctgtttgacggcatttcttcaaaatgatgtgcctgtggttttttataaatgatttcttttaaaacctgtttgatctcttcgtctgacgtttcagcctttcttaacagatctcttaaatttcctgcttcttcataataaagacatggtttgatcccaccgatagaagtcaaacgaatacggttgcatgtatcacaaaattttccatgcaatgcctcgatccatccgatcattcccttatatccttccattgtttcataaactgctggcccatttcccattctttgttcggttttgtgaaatctgatcccttgatcttttaggttctttctgatttcatttcttgttaatgctatcgttgtcttcttatttccaagcggcatttgttcaataaatcgtatacagattttatgatctttcatatagtctataaatttttgaatatcctccatcgtcgtccattctgtcaacacaacatttatctttatattcaatcctatattgaccgctttattaattactgatatgacctgtttgtatccatcgaatcctgtgatctttttatatttctcctgatccataaaatcaagacttatattgatcccatccactcctgcctctgctaatttcactaaatcttttgataataagattgcattggttgttaacgtaactttattaactccatccgttttctttaattcacggataaaatctgaacaaccttttcgtaccaacggttcgccacctgtgatcttaaatttgtcaattccaagcgttgtaagaatcttacatactcttaggatctcctcatatcttaaaatctccccatgtgacaacatttcttcatgatcagggcggcaataggtacaatataaattacaacgatccgtgatcgatattcttgcataatcaatggttctttgaaattgatctttcatctctttctcctatcgttattctcaaccaagaataacgcctgcctaaaatcagacaggaaaaaccatgttttaacattcttcctgtctgttcgttcttctattctaatatgattgatttttcttctttttcttctatgtacccaattattttagcacatggaattgtattttgtaaatcctctaataaattttttgcatcattttcgctaactgcgatcatcaatcctccagatgtctgtggatcatataaaatatcttccaatgctctatttatttttttagtttttgaaacaccttcacttgcatatttacgatttctataagcaccttccgggatcattccaaggtctgccatagaaagagcttctttgtgatatggaatctcttctgtcataaaatgaatcgttacatcactgccctgtgccatctcataaccatgtccaagtaatccaaacccagtaacatccgtacaactgtgcacttcatattttaccataatatctctggcatatttattgagctgtctcatctgatcatagatcttatccattactttttgatcgataaattcagcctttgctgatgttgttaaaattccaactcctaacggtttggtcaaaattaaaatatctccaggtcttgccccgctgtttgtcaaaaatttttgaggatgtacaaatccagaaacagataaaccatatttgggctcttgatcgtgaatcgtatgtccacctgtgatgatcactcctgcttcatatgcttttttataaccacctcgtaaaattgcctgaatgctttcttttggcatatcttttgtgacacacatgatatttaaggcaagctttggatctgctcccatcgcataaatatcactgatcgcattcactgctgcaatctctccgaacatttccggatcgtcaacgatcggcgggaagaaatccaatgtctgaacaagtgctgtattttcatcaattttatagacagacgcatcatcacttttatcaaaaccaactaataaccgttcatctgatcttgttggaattccgtctaataattttgctaaagttccagctccaacttttgccccacatcctgcacactgggcgagttttgttaatttcacttctgtttccatagaccttatcctcccgtaaatgttcatgatctctcttaaacattatctcttgttacatcttttaaccacttgaaactgcgatatctgatcaatgtgatcggtactttgatcaattcatcactcatcaataatacataaactgccggcacactccaatgtaatacaaatgcagccaatgctcctaataaaatcgaacatccccacatcgttgatacatccatgatcaagccaaacttcgtatcgccgccagatcggaagattccaacgaccattgttgtattaaatgcctgtgcgatcacaaaataagacatcacataaaacatcattttcagatagtatcttgcggttgcacttaaggataagaaagaaattacaactggagatgcaattaagatcaatcctcctccaatcactcccatcaccacacttaaaatgataaaccgtttggcataggctcttgcatgatcgaattttctctcaccgatcgtctttccaagatagatcgctgtagcgctggatagcccaaaagacacaaccgttgctaactgtctcgccacctgtgcaacagaattggctgcaactgcagaacttcccatatgtccaagaactgctgtattggctgatgttccaagcccccacattacctcatttaaaacaactgggagggaatagactaagaaatctctcactaacagtttgtcctgatgaaggaaatagtgaactctgaattttacatctttattatatatttttgcataaccacaaaccagaacaagttccataatccttgcgatcaatgtcgcaatcgctgctccacggattccaagagctgggaatccaaataatccaaaaataaagattgcattaaaaaccacattgcataaaaatgatactagataaacaactgttgccacgatcactcgttcaatgcttcgcatgacatataaatatacattggtaattcccatgataatatatgaacatgcaacaatccttaaatacttaactccttctgcgatcacctgtggatcatttgtaaaaattctcatcaacgatgctggaattgtaaatgctgcgatagtgaatatcgcagttatgatcactgctgatctaatccctaatgccaagatcttttcaatcgttgtcttgtcaccttttccccagtattgtgcagtaagaacggttgcccccgatgttaatccaaacaaaaacagtaccataatgtactgaatctggccagcaagagaggcccctgataatactttttcactgacttttccaagcatcacaacatcggctgctgttactccaacgttgatcagattctgcaatgccatcggaacgaccagtgcaaatacatttttataaaaatctttccatttgatgcttaaatcattcaatctttttctcctgttcttttcatttcctcataataggatatagaagctttgtctgcttgtcaagcacatattgcctgcctgtatttcatttagtatccccaaaaatgaaaaataaaaaccacttaataaaatcatctgcagattcatcattgcgatatttattaaatggtctttacctttataattagaatttaattttttggcatttatagatatgtagtttattcttcgatttttaatgcttcttcattgctgagctctttgccatcttttgttgttgcaacatagtagatatcaccttcttctggctgataatagatatctaaatttacgatcgtgttcattttaataccagctgcttttaaattttctttaacaagtttctctgtgtcttttacatctatgttgcgttcctgaaactgtacttcgatttttgttttcatactactctccttcttcttgatcatctactctttatgtcaactcttgatgtgattattattagattcttgtatgcgtacattgtattctacatacgatttataattcatattatagcctttttttccaatttattcaacttgaatctgatttagtacaaaatctatctacttttccttgatcttttttccataactttttggatgatcatatctgcgatccatccacataagagcccaatgatcaaacctcctaaaacatccgttggataatgaacgtataaatacattcttgaaaacgcgattaaaacagatactatcaaagctcctgctgccattctctttcttcccgcaaaatacagtgcactgaccgatgcaaatgatgcagctgtatgtcccgatggaaaagaataatccttcaatggtgtgaccaacagctggaccgtctgattaatgctatatggtcttattcttgccacgatcggttttaagatcacattacaaatgatcaaatctgcaattaatgcaactgccatgtatactcctgattttcttgtttttggtatcagtaataaaatgactgttaaaatgatccatacgatccctgcatctcccagtttcgtaatagctaccataaatctgtctaataatggagtatggatcgtttgaagtttgtctaaaatctgaaattcaaatcccataatgattttactctgcctttctttttctattataacattgattctttgattttataaaacattgatacataggttgtatccttagattctaaaatatgccgtactcctatttctcgaagctgcttcgttgtcttttctccaatactgatacacggaatattctctatccattgttgcttttcttctcctatctgatcaaaaaatcttcgagctgatgatgcacaggtaaaagaaacacttcggatatctttcatttctggaatttcacttaaaatctttctattattttcatacatgaccttttctgttacctgacagatcggtgtaagggctttttttaatttttctccaccagatatgcctttacagtaccagaccacatcctttgcatctacttcctgtttcataagttcggaaagattgatctctcctgcttcttctggcataagatctgctataatcccatattgcatcaagacatcttttgtctttttacctacaacgacaatttttttatcgaagagatctcgaagatccagattcgaagatttcatctgtttcataaaaccatgaactccatatctgcttgtaaaaatcagataggtcactttcgctaattcctctttggaaatccggtcatatctataagaaatctctcctgtctgaagttccttgaccttacatccatgatcttttaatatctgcgctaactttgatggctgatctcctattttggtaactaaatgacaggtcgtatcttctggtttttgaatctgtttttgaagtttcacaacgtctcctacaacaatgactgctggtgatgaaagtttttcttgctttactttttcatgaatcgtatttaatgttgcttcacatgtttgctgctttgtagatgctgcactagaaacaactgcaacaggtgtattggcatccattccattttttaatagattcattgtaatctcttctagtttcgaaagtcccattaagaacactaaggtttcttcagactttgccatagatgcaaaattaagatcagataactgatttcttcgatcatgtgctgtcacaacacggaatcctttggagattcctcgatgagttacaggaatccccgcaagttccgcagctgcgatacaggagctgattcctggaacaacttcacaataaattccatgatcagctaaatatatggcttcttctccacctcttccaaagacaaatggatccccaccttttaaacgcactacgatatcatattgtaatgctttttgtgctaataattcattgatctgttcttgtttcatcgtatgatgatgattttcttttccaacatagatatgttcgcatccttcttttgtttcatctaataattcttgtggaatcaatctgtcataaatgacacaatccgctttttttaagatttcttttcctttaaccgtgataagtcctggatctcccggtcctgcaccaattaaatatacgattcctgctagctgttttttgatattttttactgccgtttgtgctaagatctcagggcatgttccataaactttcgtatatgcctgtttgcttccatcttcatttccaaacatagcatatagttcgtacccttgatctgtcttttgacatctggcacctgccggagtatgacaactgcctcccatttgttctaagaaatttcgttctgcacatacttcgttcattgtttcttcatcacaaaatacatccaacatcttttgcaattctttctgatcttctcttacttccaaagccagagcaccctgtgctggtgctgagatcatgtcttctggcgccagatattgcgtgatcacatcttccattcctagtcttttaagacctgctgccgcaagaacgattccatctaattgttgttcctccatttttcgaagtctcgtatcaacattccctcgaatatttataatctgaaggtctggttttaactttaataactgaaatgctcttcttttgcttcctgttgctatcacagcaccttctcgtaattcagacagatgtttcgctgttcgaaggatcaacacatctcttggatcttcccttttccatacttttgtaaaaacaaggccttttgccggggctgacggcatgtctttcatgctgtgaactcccatatggatttccccagaaatgatcttctcttcaatctctttgacaaacagaccttttccaccaattttatctaatggtttattctgaatcttatcaccttttgttttaatgatctggatttcaaaagtgtgttctggataagctttcgctaatttttcctgaacatattttgtctggatcagtgcaaggcgtgatcctcttgatccgatgatatatttcataggtcattttcctttctttgtctctatcccaaaaagctgttctaccatcttcttataatctgcttgttcctgtcttgtttctaaatgttttaattcctgaatcggttctttgatcatgcgctgcaaggatgcatttaacaccttctttagaagtttctgctctcttgttccaaaatctatttttcttgataaatatgaataactatcttccacgatctctgtacatttttcttgcaaggagcgaattgtttcttccattggtgcctgaaacagccactgcatcgtttcttcttttgctttgctgatcatcgtattgctttgtctgcaaagttcttcacgttctgactgatttgctttagaaatctctttgatcgtatctaaattgatcagatttacctttgagtcatctgaaagttttggatcaatatctcttggtgttgcaagatctaaaaatgtaacttgtttttctggcgtataatattcttgttttacaaccacatgtggtgctgatgttgcagatactacaatatcacattgtttcatgatctcatatctttgttcgtaagaaatgatctcaatctcttgaaactctttctgaacatttcctgcatgtgccagtgttctgctgcataaataaatcttgcctgcttcatattcctgcagataacgaagtgcaagaactgcagtatccccgcttccgatcaccaagaccattttgtctttgatatcacatattttctgtaattcacagattccgatatatccaacagatactggtttctcacttattctaaacgttgtttttaccttttttgcacaagtaatagcatctcttacgactttatttagttctttcttgctaaatcccatggttcttgaaaagtccaaggcatcttttacctgtccaagaatctgatcttctcctagtaccatagattctaatcctgcggttacttgaaacagataagaaactgctttatcttcttcgcaatgtctgatatattgctcgatctctgctttatcgaacatatcacagtatatattttgtatttttttgatctgttgttcatcatcaaaaaaataataaatctcactgcggttacaggtcgataagatcatcacctgttcaaccccgatttcctctgctttatgaaaaaattcaagcttcttctgatccgtaaatgaaatttcatcacgaatggtaagatctgcatttttataatcaattcctagaaatccaaactgcatagagcctctcctgcaagtttacatgttttctcaatatcttcttctgtatgtgcgttagaaataaacattgtctcaaactgagatggtgcaatataaattccgcgatctagtaaatatccaaaataatctgcatactgttctgtattggatgtcacagcactttcaaaatctctgactttctggtctgtaaagaatacactcattaaagatccaatctgattaacacaaatatgtccttttcctgcttctcttgctgcatcagcaagttttcttgttttttgctctagtctttcgtaaatctgcggatcattttttaagatatttaatgtctcaattcctgccgttgttgcaactgggtttcctgacaatgttcctgcctgataaactggcccatctggagagatcatctgcatgatttctcttcttccgccatacgcaccgatcggcattcctccaccaacaatttttccaagtgttgtgatatcaggcttgatattataatactgctgtgctcctcctagagatagcctaaaacctgtaataacctcatcaaagatcaataatgatccgtgatcttttgtgatctctcttaaaaattcgagaaatccttcttctggaagtactaatcccatattagctgccaccggttctacgatcactgctgcgatttgatctttattttcatcaaatagtttttgtacagaatctttgtcattgtattctgcaactaatgtattcttcgtatcatcttttggaaccccagcactatctggaacagatgttgtaagtgctccagatcctgcttttactaacaaactgtcggaatgtccatgatagcatccgcggaatttaacgatcttatctctccctgtaaaccctctggctgcacggatcgcactcataacagcttctgttccagaacttaccagacggcttacttccatagacgggatcaattcactgatcaattctgcaaggatcacttccttctctgttggtgctccgaaagtcaaaccgttttcacaagagtccctgacttttttgatgacttgaggatgagcatgtcctaagattccaggtccccatgaacatacataatcgatatattcatttccatcggcgtcaataatacggtcgccttttgcagattccatgaatcttggagtacgatttaccgcacggaatgcacgaactggactgtttacccctcccggaatatgtacttttgctcgttcatataattcttttgatcttgtatctttcattttatctttcctcttctttcagccattttgcaacatcaagtgcatgatatgtaatgatcatctttgcaccagcacgttttaatccgaccatattttccataacgatctttttctcatcaatccatccattggccgcagctgcttttaccatagcatattctccgcttacattgtatgcaacgatcggaatattgtatttcatagatgcttctttcataatatccatataagcaagtgctggtttggcaatgatcaagtctgctccttcttcgatgtcttccccgatctctcttagagcttcctgtccatttgccggatccatctggtatgtttttctatctccaaatcctggtgcagaatgtgctgcatcacgaaatggtccatagtatcctgacgcaaacttggcactataagacatgatcggtgtgtatacaaatcctgcttcatctaaagcttcacgaatagctttcactcgaagatccatcatatcacttggcgcaatgatatctgcccctgcttttgcataacttacagatgcctttgcaagaagcggaagtgtttcatcatttaagatcactccatctttcacaagaccacagtgtccatgagatgtgtattcacaaagacacacatccgcaatgatcaaaagttcttcatactcttttttgatctggcggatcgcctttggcacaattccatcttcagcatatgcaccgcttccaacttcatctttatgatctgggattccaaagattaaaattgctttgatccccgcttctttgatcctgttaatttcctctgataaacgatccagcgaatactgataaatccctggcatagattctacaggatgtttgatattttctccttctgtaacaaagattggatagatcaattcgtcaattctcacatgattttctcttaccatatctctcatatagttgcttgttcttaatcttcttgtacgttccatttttactgttcctcgatttcactctgatatatatttttgaatgatttcattgattcgttgttcttccaatgaatcaatatcctctaatccgatttgtaataattctttataaaatgcctttcgttcctgttctgtggcaatgcatgattttgtaagctttctcagacttcccaagatttgtgcgagttgtcctaattctttattcaaatctggtttgatcttttcttttaaatactgtgtgatcaacggactctgcccgccacttgaaaatgcagcgacaacttctccttcttttacataggatggaaaaataaagctacaatcttctttctgatcgaccgcattgacaggaatcttctttcgtctgcagatctggctgatctcatgatttattttttgatcatcggttgctgcgatcacaaaatctgcctcattaaaatctttctccataaacgttcgaaagattcggcaaatctgatcgatctgccgaatctgtgttatcatctctggtgcgatcacggtaatatctgcttcaaaatcttttaaaacttcaatcttacgaagtgcgatcttaccgccgccgatcactagacattttttcttctttagttgtacaaacattggaaaatatgccattatctctgtgtcctattttatatattcttttgcgatttccttgattccttctgggtgttttaaattccactgtgaaaagtcaagttcttcactctcaactgcctgtcctaattttaccaagaactgtggaatatcttcttctaaaatgatccctacttcttctcccatcttctcttttccctgaagatcagatccattgatatgaagtacaaatgcagaatgagcaactttatcaattacttgcatacttccgtggaatccgatctctccgatctgatgtgttccgcaagaagacatacatccagaaatatgaatcttaggcagtgaaccatcctttaatccagcttctctttctgcttctatcactttgtttaataatccttgagaatctcttaatccaacctgacagatcgttgctccgatacaagatacagatgtctcaaacaacgtttctgcaccatcatctgtcgcatctaagactttctttgcttcatctcctgtcagattgatgatgtacattgtctcatctggtgaaattcttgcttccacttcatccatatctttgatcacatcatagatctctcctaatttctcaggttttggacagccaccgaatgggtgataagaaactgcatataatccttcctgtttctgatcgagcactcgtttaccagatactttacttccatctccctgtttcttcacttcagaaatttctacatgaagatcaagatcctgtccggatgcgaaaacttcatctaatttctcatggaaagctttgatgtatccttcttcacctaaagtctcctgcatataacgcgttcttgctcttccacgttgtttataatttccatgtgcgatgaatgtttctctcattgcacaaatataataaagaatcttctctggttgtacattctcagcaactttcagtccaaatctcgcattgttaccaagtcctccagcactgtaaacatcaaagtttccatcttcccttgccacaaatccaagatcacggaatgttgcatgtgtctcattagctggcccgtttgaaaatccaacttttaattttcttggcataacttcttttttgataaatgtcatcaaatattctccagctgcttcggcatatggaagaacgttaaaatattctcctttttcaacacctgacaatggagatacggttacattacgtggaaaatctccacctccacccattgtgacaataccatgatctaatccaccttccatgattccataaattgcttctggctgtaagttatgtaactgaatcgtctgacatgtcgtcaggtgaactttatctacattatatgttttaatactgtctgcgataaattttaatttatcttttgttaaatggccacctgacatacgaagacggatcatacttgcttttccatctttctgtgcataacttccgtaaccaccggaaaatcctttgtaatctgctttacttagttctcctgcataaaactggtctgtcttttctttaaatgctggcaggtcttgtttccattcctgtggattgatcgtttccatatgtaaaattcctttctgaacattttgtttcttttattatgtgaatccttataaaatactacatttgtcttatcataccacatttacataattgtttgaatgatttctttccttttctacaagaaatgattcgattgcttttgcaaggtttttatgtccttcttcattcatatgttccatatctgccttacttggcttggctacatcacttgctgcaaggaaatcacatccgtacttccatgcaatctttaaataagtctgttttaattgcttggatactttcacagaatgctgattaaattcaagatcaaatcctggtttccatacatcttctcctaattcgatcggagatactaataaaatatcgatcgctggatcagcttttctgatctgctggatcagtttttcgattccttttccaatgcgatctgcacttgcatggttatatgttttgcagtcattggttccaagcattaaaacaacctggtcaagtggtgcgtgtgtctctaagagcattggaagtactttcgctccatttcttccatctcttgtcgcatcgtcaaatacactggttcttccacataatccttcttctataattcgatatcctttatcgtaaagcttctctgctaaaattcctgtccatcttgtttctctgtcatatcttcttgttgtacctgggatcagtccatatgtattggaatctccgaagcataatatttctttcatctctgtcaccttcttcgttgtatttcatataattctaataggaataatatgattataagaaatgaaattgtacttgtcaataggttatgaacagaaaaataccttataagatataaaaatatcctataaggcattatagatttgtgctatttttaatttaatttttctcacaagcactctgaattatttttttccaaccatactttttatgtttccatcgctcctcttccattaatggctcatacttatcacacttaatctggtcaaaaatggttttatcataaattcccaaagcaattcctgccaaatatgctgccccaattcctgataattcttccatattaggaaccaagacagtatttcttagcatatcactttgaaattgcatcaaatattcattttttgttggtccgccatcaacttttaatttttccatcttaatatttgcatcaagtgtcatcgcatcaataacatctgaaatctgataggcaatacattctgtacatgcccttacgatctctgccttttttgtcgttcttgtaattccagataattctccttttacgtgactattccagtaaggcgcacctaatcctgtaaatgccggaacaaagtataattcatcattttgttctgcttttttacaaagtggttctacttcttttggcgaactgatcaactcgacatcgtccttaagccatgagatcacagcacctgtataattgatatttccttctaatacatatgttactttcccatcaactccccatgctaaagaagttgccagtccatgttcacttaatacagcttcttctccgatattcatcataatggaggaccctgttccataggtagcttttgtctctccttttttgtggcatccatgtccaaataaggctccatttgaatcacccattacagcatgaatcggaacttgatgttcaaaaaatccttcaaaatctgttgttccaaaacatgaatccgatccgcagacttctggaagatcttctttattaattccaaaaatctcacagatttcctcatcccatgttaatgtaaaaatgttaaataactgagttctagctgcatttgagaaatctgttttgtaagacttttctttacttaactgatagatcatccacgtatcgatcgttccataacataactcatgtttttgtgctttttcctctgcaccttctacatgttttaacagccatgaaaactttgctgctggaaaatatggagaaagtggtaatcctgtatgttttttgattctttcagttaacatttgactttcaatttcttcacagatttctgttgctcttgcacattgccagacgattgcgttattcatcgcacaaccggtgactttatcccatataaccgatgtttctctctggttactgatcccaattcctgcaactttatttttatcaatccctgcgtctgtaaccagtttctttacaacataaatcgtattttgatagatttcttccggattatgtgatacccatccaagatcattaataatctgtttgtgtgaaaggtcttctcttcttaacataatacctcgatcattaaataacaaagcttttgtgccttgcgtactctgatcgatcccaataatatatttttctgacatatagttttccttttctatgctagaagttccataatcttacttataataccctcttcatttaaagcataatgatcaaaaacttctttggatgttcctgatacaactggtgcatctggaagtgccattgtataaacttttttcggacattctctggaaattgtctgtgctgtcattgatcctagtcctcccataggcgcatgttcttctactgttataacaatttttactttttttgccttttctactaatgttttttcatcaaatggttttaaacaatacatatctaaaactgctacatgaattccttcttcttccagcttgtatgctgcatcttttgctgcttttaccatctctccgcaagcaacgatcaacacatcttctccatcttttacagacacagcatgatctaactggaaatccaggttattttcttcataaacattttccaccgcatttcttccaacacgaatatatgctggtttttcgtcttttaataattcttctgttaatttctccgtcagtgctgcatcacttggaatataaactcgcatgttagggattgcactcattgccgcgatatcctgtgctgaatgatgactcattcctaatgccccatagctgattccaccactgataccaatcagttttacattggtatttgaatatgcaacatcaactttacactgttcataacttctggtagataaaaaacttgccggtgatactgcataactttttttaccaatcttcgcaagtcctgctgcaatacttacaagatcctgttctgcaatacctgtttctacaaactgctctggatatgtagccgcaaatggtgtaaaagatccactccctctggaatcactacaaagtgcgacaatatctttatctgtttttgcagcttccattaatacatcacaaattttttgtttatttgccactgtcttcattattgtaattcctcctcttttctttttaaatctgccatgatctgatcatattcttctttggttggcactttatgatgccagtttgccttattttccatgatagaagatccttttcctttgatcgtgtttgcgattaataccgttggttttcctttgactgtttttgcagtatcgaatgctttttcaagttctttcatactgtttccatctttcacatcaatgacattccatccaaaacttttaaatctttcatgaagatcatcatgtcccataacatcttctgtatttcctgaaatctgcaatctgtttcgatcaatgatcgcacacagattatctaatttatactgatgtgctgccattgctccttcccatacagacccttctgcaagttctccgtctcccatcagaacataaactctgttttcttgatgattcatttttaatccttttgctattcctacactcactggtagtccatgtccaagagaacctgaattcatttcaattccaggaagtttattattgggatgtccaatataagccgtattaaatttactaaatttctccttaatttcatcaaggtttaaaaatcccttttctgctaaaattgcataataggattccatagaatgtcctttacttaaaataaagtaatctctgtctttatcattttgattctcaacggagatgttcatctggtgaaaatataattccaccagaatttccatttcactcatatctccgccaatatgaccagcttttcctgcacaaataatatcaatcgtatcttgtcttaatttataacttaatgcttctaaattcatgatcattttccctttctaaaatcactctccacgaagatatgcttttacatcttcttcaatcggatcataaagatctggttttatcccaatatatttacatgcttcatacaacactgaaacaacattttgatgaattccaacacaatgatgaatatacggtccctccacgatcttagcttctaatcgtttgatattttcaacttctacccataaatatgttcccatacattttggtccttcgactccttttgcatttccaagaagaagcgaatattctccattatctccatcaaatctacataatgttacttctccatgttttgcttctgctgttaaacttcctggatgttcaaatgctaatggataagttaaatctggtgtctcttttgcaacagatactggccatggaccacaatgctgtaataattctccattttcgatatctggatggcggattgtccaatcagcaaaaaatgatcttgtatcatctaatgtagctgcttctaccatgagtgctgtgattgctccatggatatctgtttcacaaacaaccggaattcctttttcatttaaaattgcatttgctgcacatggcatgattccaatctcatcctgaagagcattccaacattgaattgctgctgccttacatccatatttcttgatcagattctccattgcaacagatagcgctgctaccatttcaacttcattttccttgatagaaactttcattgtttttttgatatcttctaatgccgtttgtgtctgttcatttcctttgactgctttcacttcttcaaccaattctgtcattggaattggagataactgaatattaaatttttctaataattctccttcattgcacattgttgtccaaaaatcaaatggtcttgttgaaatctgcaggatacgaatatttcgaaactcttttacaacattacatactgccataaaatctttaattccacgttcaaatacaggatcatttaacctgcagcttgtcagatatgtaaatggaatttggaatcttcttaaaacctttcctgtcgcaaacaatccacactgtgtgtcacgaagtctaactccatctggttctggcctttcatctaatggtccccataataaaactggtacgtctattttctttgcaagtcttgcacagacatattctgtaccaaaattacaatgtgggaaaatcactccatcaactttctcttttttgaatttctctacgatcttgtcaacatcatgatcatcgtataaaagtccttcttcattgatatctgtaatatctacaaaatcaacgcccaattcctttaaacgctctgctgttaaacctctatacttaacagcatccggtgcactaaatatacttcttcttgtcggtgcaaaacctaatttaatctttttcatagtattcctctttttataattttcttccattcattttaattacctgctgataccattgaaatgattttttcttagttctttttaaagttccttttccagaatcatctttgtcaacatagatcaaaccatatctttttttcatttctcctgttgaagcagatacaaggtcaatgattccccacaggcaatatccccatagttcaactccatcttgttcaaccgcatctttcattgcctgaatatgttcccttatgtattcgattcggtaatcgtcttcgatatttccatttgcgtccatggtatctgctgcacctaatccattttccacaataaataatggtttttgatagcggtcatataaagcattcattgtaatacgcaatcctaatggatcaatctgccatccccattcacttgtttttaaatatggatttttaactcctgagaacgcattccctcctgtcatttcaacatctttattgacactggtacatcgagatgaataatatgagaaagaaacatagtcggcagtattttcttttaagatttctttatctttttcttccatctcaatgttaatattgttttgttcaaaaaatgcttttgcgtaagctggataacttcctcttgcctgcacatctgtaaagaaataattttctctgtccttacacattcctttccatacatcctcaggatcacaacaatatggatacacctgacctgctgcaagcatacatccgattttattttctttatcaatctcatgccccatctttgttgcaagcgctgatgctaccaattcatgatgtgctgcctgatattttacctgcatttcatcttcatcttctttaaatacaagacctgcacccataaacggaagatgaaggatcatattaatttcattaaatgtgatccagtaatgaaccaaacctttaaagcgtgtgaacaatacttttgccaattttgtgtaacattctattaatttcctggatttccatccaccatactttttaatcagatgaactggacaatcaaagtgtgagatcgttactaatggttctatgtcatactttttacattccttaaaaatattttcataaaattccaatcctttttcatttggcatctcttcctctcccattggaaaaatcctcgtccatgcgattgaaattcgtaacgtttttagtcctaattctgcaaaaagggcgatgtcttctttataatgatgataaaaatcaattccctccatcgctgggtaaatatgatctttatctggttctaacattatttttttacctaacatcactggaaaacgatcttctcctgatggaatcacatcgacatttgctaagcctcttccatcaacattgtatgctccttctgtctggttcgcagcgattgctcctccccacaaaaaatcatttttaaatgcactcattttgaaactctcctgttaaattcatttatataacatttataattactctttggaatgactttaatttatatccgtattgtttttgcatcataaagatcacatgaatctgatcaccttttttcgcattcttaggaatcttaatacgaaaatctttctcttttatattggatttttcctgatcctttataattttcacttcatccagattcttgcaggaagaagcttctggatagataaatgcttcactgacaatatctcctgataattcacttgtaactgatgcatgaattaagacttcttcccctgcttttaccaaatgatcccttccattttctatcaaaaattctggtgcatgatcttcttcacaaaaagttgtttctacacaccattttgctcgtgctacaaaatctctttgtatgaattccacatatctccacatggattctgtctctacttcatttccatttgcatctttgtaaacatcttttgcactttcccaatagtttaaaatctcaccttttttatttttcttttcaatatttttcacatatcgtcctgcaattccaccataaccaaagtgttctaaactgcgaagccctgttggcaataacataagaaatgttggagaatctccttcagacaaaaagtcatactgtttatgtattccaagtccaaattttttcccccaccagtcatttaataactttttgttacttccaaactgatatttttcaggttctccttcatattcttttccgtctgcccacgttgcataaccttccatcaatggaccatttccttttacgatctgtctcataaaggaatcttttaaacatttcttactttctccatccggcattgtcttccatgcataagcataacttcccatctgtacacacgaaataaatgccagctgcggccactgctgtgctatatagttttgatatgttgggtcttgttctccacaagctaccaaaactactttcttcataatctttttcttttgtaaatcccagtctgtatcattttgatgttcacattcaatatcataaagtgctctggcaatcgtgttggttccaccccagatctggagataaagtattctctcatcattatccataatgtgttctttgatcaactttgatccttctgtttcttcatccatttctcctggatagcctatattcccaatttttgttacatcttttaattcttgtgctgttggataattcaaactctgtaaacaaagatttttgtatactttctcataatcctttaatacttcaaacatccactgtgtacctgtccaacgataaggttcatcatatcttcctttcggtgcaaattcatcaccttcttttacttcaggtgtttttacaccttttttccctttccaatgaaaaatagaagatgtctgaatgatcccttgtatttcaatatcgtttgcatatagtaaaagatgtctgaatgaattctgatcatctacttctgcatcttgtgtcacaattgtcctgattttataatccaacattttttcctcctagtcctattttgaaatcaatgaaattgctgcatctccaacattctttattcctgtttgttccatcacaatcttatgatatgcatatccatttgtaataaccattggtgtcacagcatcatatccagcttcttttaccttagctaaatccacagtcactaatggctgttttgcttttactttttgtccaacttttacatgaactttaaaaccttttccattcatttttactgtatccataccaatatgaatcaatacttctgccccatgatctgatacgatcccgattgcatgtcctgtttctgctactgctgtgatcgttccattacaaggtgattttacttctccatctgaaggttccattgcgaatccttctcctaaaactccagatgcaaatacttcgtcttttacatcctttaatgaaatcatatttccattgactggtgcacctaaaatctcatcatctgtctctaacttttctggttcatctgctttttgctcatcacgtacgatcatattatcggaaaatccaaacagatatgtacaaattgctgatccaaagtaggcaatcacacatgcgatcacaagtcctacaaatcctgtaccaagatatcctggcattgataatatggacattccaagaactgtaggtgcactggctccaacggctgctgtaattgctcctgcaattcctgaaaatactgcaccaataaaaaatggttttttatatggcagagttactccatagatcgctggctctgtaattcctgcaagcactgctgaaattgcggcagatccagaaatagattttaattttttatctttcgtttttaagaaaacaccaagtgttgctcctgcttgtgcaaaattatttggtccagtaattacaaataatgtatcttttcccatggttgccaaattgttcataacaattgggaagaatccccaatgtaatccaaaaatgactgctgctggccagatcaaacctaagattcctccggctaaaatcggattaaatcctacaattgctgaatatccagctgctaataaggaaccaaatttgtccataaccggaccaatgatcaaaaatgtagctggaaccatgatcattaatttgatcatcggtactgcaaacatttttaaaatttctggaatatattttttcaataatttttctagttttgacataatatatgttgaaatgataattggcatcactgatgatgcataactgatcaaatgtacattaatccctaaaaaactaattgatttttcggctgaatacagtgctgtcatgtttggataaactaatgccatccctaatgcaatcgatgtaaactgactgcatccaaattttttaccagccgtatatcctagtaaaattggcaaaaatgtaaaaattccatccgcagctgcataccagatctgataagtccctgatgtttctgtcaaaacatttaatgtcgtaagtaagagcaataaagctttgatcgtaccagctcctgccaaaattccaagtgccggtgcaaagattcctgaaattgtttccattaatacattaatgatatttttcttttctccaccctgatcttctgattctttctgatcttttttaatatctgagtttttcaaaactgcctgataaacattgtctacttgatttccaatcactacctgaatctgacctccagaattcattgccgtgatcacaccctctaaactctttaatttgtctaaattgacctcttcattcttctttactttaaaacgtagtcttgttgcacaatgaaatactgaaataatatttttttccgtacctacatatttgacgatatcttttgataataccgtataatcttttcccataataacctccgaagcagaattcctatattttcattttcatttttttagcgctaaattatttttgcatttcttaaatgctgattacatcatacaatattccgtatgatttttacatgacatttccagacctaagactatcaaaatcagactttttctgttaaaataaatatattatctttctaatacaaaatgtttagaatttgatgatattgtatacacaaggaggcgttcttatgaataaaacagaatttcgaaaaaaagtctttccactgacaaaaaaagaattttattatctttctaatcaaaaaaatatatcttccaaaaattattttgatcaagaatctgacacttttgatgattttccaaatgatcaagttcttaatttacaaggaaatctctctcaacggctttctataacaaaaaatcatcatgctttattttttgatgggcaaaaaacccctatagaaatgttgaatcttcctattttttgttgtaaacaaacacgtttttcaaaagtccctattcacactagaaattatctggaaattaaatatatatattctggaagttgtgtagccttattaaacgataaaaaaatctacctttcaactggagatcttcttcttttagaacaaggttctaaacacagtatccttcctgccggaaaaaatgatttgatttttaattttcagatggatcgctcttactttacgcaatcgtttattaaaaaatttgaagattctgatcctatcactcattttttgacaaatgctattgatgattcaaccagacataccaattattgtttctttcaaaatcgtaaggatgatgatgaagatattcgatttttgattgaatcaattttatgcgaatatcttgatccaagtacttgctataaaacgattctggatgccagttttttaatattatttggaaaactggtacagcgatatatggcaaatcaggaagaatcttttcaaaatgataacaaaagctatattacagaaatcgttctttatatccgtgatcactgtgataccatacgatctttgcaagaagtagctacacattttggttataataaggactatctttctaagttattaaaacgtaccgtaaatcagtcttataagaatctcatcactacctttcgattagaaaaatcttcagaaatgttagctcacacagagaagcctatttatcagattgcagaggattgtggtttttctaatcttagtttcttctatcaaaagttccaaaatttttatcattgctcccctgccgaatatagaaagcattaaaaaaatggctttatatcatattttgtatatgatataaaaccattttttcgttattattatataagttaatttataaaggggttagtcattcttcttcccaaacaataaacttacgatcacacttaaaacaatcgtgatcaccatatcaggaagtgtatttccaaggatcgtatcaacccccattaaccagcgatatgcaataaatccaacaacccatacaagcatgttctggatacatacagattttcttgagaaatcctgatgaaggataaagaaatctgcgatctgtacagcgatcattggtgcaaagactgatccgatcagatataagaaatctgtgatatcgtccatcggataaacaattgccccaatcattccgatcactgttgccgcgatcgcaatccattttccattaatattcttagatagggattcactggaaattccggcagaccaagcatctaagaatgttgttgttacagttgagaatacgataattaataatcctgcaattccaagtcctgcttttaccatgatctgtgcgatatcggattctcctgtaaagatagagattcccataccgatcacatacatccagcagctgaccaatccataaacgatcacacttgcccatgttgctttcgttggttctttagcttctcttgtgtagtcactgatcagtggcagccatgataatggcatggcaactgcaagttctacagctgctccgaaagttaatccatcatttgcaaccggctttaatgaaccatgtccgaaaataataaaacttaaaactaatgtcaaaataaataatgctgccattgcaaccgtattgatctttcctaaattttcaattcctaccagaatccagataatgatcaatcctccgataatgactggccatacccagttcgcaatattgaagattcctgctgctgctaatgatccgtcatagatcatgatcgctgtccatccaactaactgcaggatatttaacactgcaaataacaaagctcccgttgatccaaaactcatttttaccgtttccattgcactttttcttgtctttccaccgataaatccggcaaaaaacatcataccacatccaatgatatgtccaatgatgattgctaataatcctgtagaaaatcctaaggatgcgaaatatgtacctgttaaaatttctgccaaggacactccggctccaaaccagatcagtccgttttcaaaaattgatgttcttctgctacccattgtctatgcctcctctttccattcatcttttaaatcaaatgcatgattcattggtccgcttccagctccaagatccaacatatctgccaatgctcttgaaatatagtcttttgcacgctgtacagaaatcttaaggtcaaaacctttggcaagatttgctgcgatagcacttgaaagagtgcatcctgttccatgtgtatttgggttattgattctttttcctttaaaccaggaaacttcttcttttgtatataaaaggtcatttgcatcgttaatattatgaccaccttttaataacactgcgcatccaagatcttcatagatcgcttttgcagccgctaccatgtcttcttctgtgtgaatctccattccacaaagaatctcagcttctggaatattcggtgtaattaccgtagcgatcggtaataattctttctttaatgtatctacggcatcttcttctaataatcgtgatccgcttgttgctaccatcactgggtcaacaacgatattttccgctttataatgctgtaatctttctgcgatcgttttgatcagtccgcttgaggaaaccatcccgatcttgactgcatcgggtctgatgtcttcaaaaactgcgtcgatctgtttctttaagaattctggatctgcttctaatattcctgttacgccggttgtattctgggccgtcagtgctgtaatcgcactcattgcaaatacaccattcattgtcatggtctttaagtcagcctgaactccagcgcctccactggaatcacttccagcgattgataatgctgttctcataagtatctctccttttctctcttatgcattatttttctattgcgatcaaaagtggtgctcccagttgaccgcattgtttcgtatcattgtaaattcttccataataggaatcctttatcatacgaaaaaaacggaaagctactgattttgtaactttccgtatgttcgcgacttatcatcttcgtttcctacgttggcattacccaaatcaggttcaaaggtcgaaagttttactttcctctcagcctgtttaacaagctccctgtttttataacttaataagtatatagcaagtttctctaaaaagcaagtttctattttcgtactttattgcttttttttatttttagcttatttttcttggaaatatcgttaaccctaactttttcataataaattcttttcccaaaaaataaattttaaatctcttttccctttgtcacgatcacatgaatgataaatggaataaacaatgtgataaatgctgcatatccaaggtacgcatatccctgttttacaacagccaacaatccaaactgtgcgatcgcaaatgctaaaaatgtaaagattagtgttgcaatggcatttcttactaaatgtccattctgtctttcctgctcagatttcatacgacgctctactgcattgacacatcttgttacgattccagagatcatgtttaccgccgttgaaatagatccaaggatgatcaaaacagagatgatcggtgttaataatcctgaagatactccattttgtactaaaactaacataggaactgttgctgttacaaggtctgctgcgtatgcaacggctaataatccgatgatggataattccattgcaaagaaattaaatacaaaaatctcaatggctgctttgttgatctgcttcttatctgtcacaggttccatatgctggtacataacagatacagatgctaactggaagaagaaatataaaactgcagaatataaagctggtccaaaagctccgctttctccagagatcacaggcatctttcctgatactaagttagagattgctgctgtgatcgcatcccactgtacgatgatgtttggtactaatacaagaactaatccgatcaagatcagtacacttaaagtagatgcacattttcttacgacacttgttccaaaaagtgcgatcacgaaaataaatgccgctatgatcaatgtacatacccagtatgggattccaaatagcatttgaagtgttgatccaccagttgcaaatgctgcagcggatgccgttccgatcatgatcagataacagatttcatatagatttgacatgatcggtcttgtctttccatataaactgtcagaaaaacttctgtaatcatatgttttatgtttgtatgcataacgcattccataccagaaaaataatgcatataatccttgtgtgatcaatggcattaacagacaccagattccgtagttgataaaatactgatagatctgtgctccggaagcaaatccacctccgaactgtgtcgtaaatgccacgaatgcgattcccatggcaagaggcatcttactcttgtcaactagtaaactttttttgccgctcattttgtcgtcctctcttttctcttaatgtagtctgatattctagttttcatcgatcttgatcatttttcctggattcaagatcagcttatcatcaaatgcacgtttaatagacttgtatagttcgatcattcttggtcccgcaaattcctctaagaaatcaagacgtccgtttccgattccatgttctccggataactgtccaccaagtttttttgataatgcatataattctgttaatgattcatgggttgccttcttccaatcctcatcgctcatctctggtccacgaagcatttcggtatgaatgtttccatctccgcaatgaccacatggctctacgcggattccatgtgcagatgcaatcttctttgcctgttttacatattctgcaatctctgatcttggaacaacaacatcacattcttcctgtgcaacggaatctgccttcattccttcaagaattgctcctcgtacttcccacacagatgccgcacgttctggcgttcctgcgatattgcaatctaaagccccattttccaatgccgcttctgcagctgcttctactgcacgatcaagttcttctttgcttgatgcatcatacataacgatcaatactgcttctccgtgtttcactggaaacagtttatgtagacttctttctacaatatcgatcaattctctttccaaaaattcaatcgctgttggaacaaatggcagatctaatacttttggcaccatatcagcacattcttccaagcttctaaatggcataaccaatgtacttgaacatgttggtgcaggcaataactttaacgtaacttccgtcaaaatacataagattccctcagaaccaatcactaaatctttcacatcaaatcctgttgtattctttacgacattggatgagaaattcatgatggaaccatctggcataactgcttcaatacaacggacaaagtctcttgtaagaccatatcttaccgctttcattccacctgcgttggtaatgacatttccaccgatagaagctgttttttctcctggatctggtgggtagaataatccttcttctttagctgccgcctgaatatcaatcaacaatgctcctggctgtgccgtgatcgtctggttcttgtgatccactggaaaaatcttattcatacgcatcacagataacatgattccaccgtatttacaagttgctccacctgcaagtcctgttccagccccacggcagacaactggaatattctgctcgtaagcatatttcatgatttctgaaacttcttctttattcaatacttccacgtataattccggtggaaatactccatattccggcatctcgtctttgtaatattcttttgcgatctcatcgccgacccatacacgttcgttgtctgtgatctcaatgatcttatcaaaatcttcctgggtcatcttcttatatggatatggcatcttattcgtcccctttctgttgttttactaattctgtcagatatggaacgactttgtacagatcatcaacgatacaatagtgtgccacattgaaaatctgagcttctggatcattgttgatcgctacgatgcattcagatcctatcatacaagatgtaaactgaatcgcaccagaaactccacaagtaatgatcagttttggacgaacagttcttccagataatccaacctgatgtgcaacatccccaaaaccattctcgatcatcggtcttgtaaatgctaactgtccacctaaagctttggctaattcttcgcacattttcacatctttttcattgcggacccctcgtcctgctacaactaagacatcttcatcttcaatattctttgttttctcgatcacttcagattttaagatctcaattggagattgtttcatctcttctttgactggacagacaacgacttctcctttggcattgtcgaccttctgtgccgcatccataactctgtatcttacagttgcaaactgtggtcttgattttgtgatagaaatctgagccatgatatttccaccaaatgctggacgaatctgtaccatgtctgtgtttgacttaatatcaatggttgtacaatcagctgttaatcctgtatggaatcttgttgccagtcttggggctaatgatcttccaagtgctgttgccccaatcaagacagaacttggtttctgtgctgcgatacattccgcaacaacatctgtataacaatctgctctaaatccttctaaggattcatcttcataagcaaaaacctgatccactccatagtctagaagtttatgtgcattctcaatggttcctgctccacctgcgatcacgcatttgactttaaaatttactttcgaagccatctttcttgcttcaccgatcaattcaaatgcaactggatgaatgtctccacgttcttgttctacaaagatcaaaaaatctttccatttgtctttatcaaatgatcctgctttctgctcaaaactgattgctttttctggacattgtctgacacacattccacacattcggcaagtgtccccgacaacaatcccattatcttcaaaacttaatgccccaaacggacatttttccacgcatttaccacatagactgcagcgttttgcatcaaattttattagttccatgtcatctcacctaaatcactttcttattcactaatacgtcaaataattgttttgtcttttcttttgcatctccgtcaaaataaacctgcttttctacttctggcggtgcaaacattttctctactgcggttggtgatccgacaagtccatatttgcttaagttctgatctgccatatcttcaaatgtcatgatcttcactgggcggtctttggactgtttctgcagtaaataagatggtaatcttggtacacacatgtctttgtcaactgtgatcagacatggatatggaatctttgaagtctgtgatacactgactaaatcctgttttacctgaatagactcgctgtctgcatctacgatctcagacacccatgctgcatgtgggattcctaaatgctctgcgatcgctggcccaacctgagcggtatctccatcggttgtctgctttccacaaataataagatctatatctccgatcgcagtgattccctgagatagtgcataagatgttgcaagcacgtctgctcctgcaaacttgcggtcagataaaatgactgcatcatctgctcccatcgtatacgcatctctcatcatctcctcagcctgtggaggtcccatggtgagaactgtaacacttcctcctactttctctcttaattgtaatgctgcttccagggcaaataaatcataaggattcgttcttgtctccccggataaacgcttcattgcccctgtttctgggtcaatgtcaactttagtacctgccggtacctgtttcatacatactagaattttcattgttctgctgcttctttcgtattatttgttactctttcactttaactgattaacgtaacactatttattatacgacaccatttttttattgtcgagttaatcatacaaaaaaatagcatctgttgtttattttttcgtaacaaatgctatttccttatctattttttcttctattcgtcatcgtcaccgacgatcactggctctttttctatcacttgttgtggtttcatcgcctgattcccaactggtgctaataatacttttcctgttccacggtatacattaaccaagccttctccactggccgcagaaccaagcaaagattttcctgctcgttctaccgtaaaatcaagacttccgctccatgcgatcgccaagtttccgtcaatctttacaacatcatcttctaatgtgatctcgactaattcttctcttgaacaatcagattctatgcacacaactccacttccttttaatccaagattaaagaatccttccccgcctgcaaatgcagaagaaaatgtctttcttctgactgctttttgttttaacgtagattcacatgctaaaaacaatccgtcatctaatacgatcgaattgccccattcgtcaagatctaataaaatgatatgtttatatgtaggttctaaaacaagagttccatctccagtatattctggcttgatcacagattctccagttacttttcctcggatcgtcttggataagaaatctcctgctcctttaattcctgttgtcgcagagacatctcctgccatccactgcatggcacctgactgaatcgttacatttcctctggatagttcgcattttagctgacgttttcttacattcatctgactgcagaagaatgctaactgggcatcttctggcatgacacttaagtctctctgatattcgataacttcaaatggtcctgatttgtcgatgatctttacatcgtcgttgtcactgaaattgctgattttatacataatctttacccttcctgtttcttctataaacttttgatctttttctgaataaatttcttcttaatattcataaaacttttgcattaccaatggcatttgcaacattccagatacaataaattgatttcgatcagatgataccttcatatacatttgattattaactgctgtttctgataaaaacatatcatataactgtgtttcaaaaatccgattcgatactgctacaatcccatttttatcctttaagaagccaaacgtaactcccaaatctataatcggtgtttctcgtttaaatgggaagtcaactcctgcaaataaaatgttttgaagcatttcttttaactgtggatgatctaacaactttttggtcatatcatcaaacaatgtgtttggttcttttaacaaaaccttgactgcacttaaaattccttctcttgtccacacttgaacatcggatactctttcatctaataactgacatatctttgaaaccaaatatggatatcctgacgtataatcatataaaatccgactgatttcttttacatccatacctgtacgatgttcctgctcgtattcttgtatcattgtctgaatatcacttacagaaaagctcatctcaatattaaaatcaactgcgatattccatggactgttatatttcgattcttcttgtggatgtagttttaactttaatgttttaatatcgtaaacacctgcaagaattacagaatgaaatgttacatcttttccttgctgacattttaaatatttctctcttagaagtccaaggaaagataagaaaatctgattgtctgaacttttgtctacttcatcgatcattagaactacctttttaccgcattttctgcataggttgctgatttttgttcctaatgatctcataggaaatctctcagagattgaatgattccattcctctaaaactttttcatctacattctgctctcgcaaacactcttcaatatcaagtgaaagtccttcggcaagacttcccagagattcaaaatattcatcggcagcttcaaaacttaaactcaaaaccagataatcttgttttcgcaattctttttccagaagataaagcaaggttgtcttaccatattgtctggctcgattgatcgtaaagtattgtcctgattcgatatattgattgataatctgctgaatcctgttgctaagatcaaccatataatttttctccgggatacatgttcctgttgtacaaaacttcttagccataaaccccaacctcctttcttgtccactctctattaattacacccttattctacaattcatcaaaatcaaatatcattgggattgtgctttcttgataatatttctgttctttttcaaaataagcttctaatcctttatagtcttgttcgtgctgtgctttattaagatatcgattatattctgctttatgaatatcacggatgatcactggaacaatattatgatccagacattgttttagaatgatcatacgcccgactctcccatttccatcctgaaatgggtgaatattctcaaactgtgcatgaaatttagcaatatcgtataatgtaattttctctgcgttatgatacttttctaataactgatgaatcttttctggaacttcttgtggcaatgctgtctggatatcactgactctgtttgcacgctttctccacccaccaattgcatatccatttgctcgatcttcaaaaacaccttcctttaaatttttatgcatattttttatgatatcttctgacaaaggtttttccatacatttcattacataattaaacattttgaaatgaccattcatttcttctatatcttttgttcgaaaaatcatgtctggatcatccacatataaagttcctgtttcaaacatacttgctgtctgtttctctgttaaggtacttccttcaattcgattggaattatacgccatactcctctgtgtataaccgtatactccgcttcgatcctgttttttaaattctatttgcagtctgtcttttaatcgtttcatatatgtttcattttccatgattttatctcacctcttttatttaatctgttatttttaagtatagcatgaattatgaatttctacatctattcttttagaagtctatccaataatacttcccgattatttataaacatctccgtaatctgataactttccgtctcctcatactcacataaatgaatcctaccatcatcaaaacaataaatgtcagcgtctggaattcctagtaaaatcggtgaatgtgtaacaataaagaactgtgctccttttcttgcacatttatatatctccattaataatgttaattgtctttgtggtgataatgccgcttctggctcatcaaaaagatacaatccattgggctgtagattattttgtgctaatgccaagaaaccttctccgtgtgatttctcatgatatctggctgaatctattccaccatattcttcttccttcgttgcaacattatagaaactttctgctctaagaaaatatccccatttttccttccgatatccttttacaactctgatggcatcgcataattcggagtgtgtatcatgcgtagaaaatacatagtttttcgttccaccttctggattaaatccatgagctatggcaattgcttctaataaggtggactttccacttccattttctccaacgaagaaattgattgaatttttaaattctagcctttcaatattttttaatgcttctatttgttttagataactgtcatcatctattttattccagtcaaatattacgccttgtataaactgatcattcattggattttcctttctatcatgataagcttcttcctaatccttttatattttatcaaaaaaagatatgacacgaaactgtcttttcatatcatatctttcatatttcttatattttcatttttctacatactcaatagcctatagataataaactatcctacattgctttcctgtatatctcagcaatttcttcctgtgtaaatacaaccggattgttctgaatacttgccgcagatactttcatacagttctctgccatccaaggaatatcttcttcggataatccaagatcagataatgtacaagcaaggtcgatatcttttaacagacttcttaatttaccagaaagatcttctgcggtaaccccgccaaagattcttgcgatcttagcaaatttgaaatggtttcctttatgggatgcttctacaattactggtgttaatgctgcaagtccttgtccgtggacgatatcttttagtccgctggctggatgttccattccatgtgccagagtgacacctgctgtattgatgaccattccaccgatcgttgatgccagtgtgatcttctcccatgcttctttgccgccttcacctttatatactttgacaaggtttcctgcgatcagttccatcgcgtataaacttagagcatctgtaaatggctgtgcgatctttgacgtgtatgcttccatgcagtgacataatgcatcgaatccgacagatgcaagtacatgttttggcattgtcatcatgcattctggatcaacaatggatacttttgcaacgatcgcattgcaacgtaaggatttcttatctccattttccggatttgtaagaactgcaaatccatttccttcggatcctgttccacatgttgtaggaattaaaatcaatggtaatgctttatcactttgtaatctgttataaatgtaatcgttgatatctccgtcattgatacttaagaatgcgattgcttttgcacagtccatgatgcttccgccaccgatcgctacgacaacgtcacatccatttgccttggcaaaatcagcgccttccatcgccgttgttgttaatggattctgtgcgactttatcaaatagtacatggtcaattcctgctttagacagactgtttgctactttatcatataaaccagatttctttgcactgcttcttccagttacgatcagtgctttcttaccatatggttttgtaagctctcctgtttctaagactttaccgcttccaaatgcaatattgactggaaggaagtagttaaagttaattgctggctgtacttctactacattttcggtagcattgacagctccaagtgcttcttcgaaagtatgatcttcttccactgtttcttcttcatcaacggcaacatcgatgtgagatccaaatttttctttgtattttaatttacatacaatgaagaagataattccaagaacagcccatccaccagccattgcccattcttgtggtacaagatttgaccctgatcctgggataatatacatcgcgaccataaatcctgacattaagactgccaatacaccaacaatcttataatgttttactttgtatggacgtgccatttctggtgctttctttcttaagatgatgaaagataaggaaaccatacagtatgcaagacagcatccaaagttacctgcatcgacgatccatactaacattttacgtccaaataatggagctaatatggataatccaccgatcaagtataatgcattcactggtgttttgtgtgttttatgtaatttacggaaagttcttggaatcatataagattcagccatagaatacattgcacggctaccaccaattaaaaaggagttccaacttgtaacgattccacacataccaccgacgatcaatacttttgacatgatactgctgtggaatgcttttgccattgcatcagctgtaacaagtcctgatcctgcctgtgaagatgaaatatcagatggactcataacataaccaacacctaagatgatcagcgcataaaatgcaactgctagtacgatagataagatcatgatcataccgatttttttaagcggcacattgatctcttctgctgcctgtgggataacatcaaatccaataaagaagaatggtgtcataaccgcaacactcatgatcgctttcatagtagttgacgcactatctcctgcaaataattgtggtgttaaattgctggcatctccactgactacagatgctacgatcagaaggattccaactccaccaatgatcactgttaaaactgtctgtaaagttgcagctgtcttcgcacctttgatattgataaatgtgataaagaatgctacgatcatcgcaactgcaagccatgatgcataaatatcaaatcctgcaacagtatacagatatccttttaagaatccaggataaatataagtgataattgtaggaagtgcacatgcttcaaaacatacaacactgacatatcctaaaataatcgcccacgtacagataaatgaaccaaccggtcccattgccttgtaactaaatacatgttctcctccacactgtggcattgctgcagtaagttctgcataagtaagtcctacaaagaataccatgataccaccgatcgcaaaaccgatgacagctcctaaaactccacctcgaccgatccagtctccggttgaaacaacccatccccaaccgatcatagcgccaaatgcaatgacaagaatgtcccatgcactaaatactttgtcaaattctgattttttcttttccattatatatcattcctttcttgcttcacattctgtttaaagtttcgaaagaaaaaggcgctaaaagatccttatctcttaacgcctttgttagaatgtaaatgtattttattttaattttcaaatcgcagatcaatcaactgcatgatatattttgctgttttttcaagtccaagaatactagaatcgatcatcatatgtctggtacgacaatctctcatatcagagcttgtcatatattcatatcttgacttcagcatcccatcattatattttacaagtttttgtgcttctttttgtgatacacctttttgctccatgatatgtttcactttatattcttctggtgcatatacaaagatatttaagcagtcatccctgtcttttaatatatagttactacatcttccgataatgacacaagatgattttgccgccagtttatgaataacctcaaattgtgtgtaaataacacggtttgtaagattcgcatatcttggtccaaaggttgtgtcaaattcatatttgacattttcttctccggaatcggctttttctaccagatctctgtcaactccaagtttctctacgacctgatctactaaatccctgtcgtaaaatggaattccaagtgattcggcaaccatctttccaatatccggaccaccacttccgtattcacatccgatatttatgataaaatgtttcatttacattcctccctgatattttgatcttttttcaaagatattattttatgctaaggactctacagcctccttcatgatcgcaaatgctttatcacattcttcttctgttacgatcaatggtgggattgtacggatcacactgcttccgatggctgtaactaacagttttcgatcaaaacatgcatgtttaatatcaactgcgtttaatgtgtcatcaaattcgatacctgttaataatccctggtgtctgacctcttttacatgaggaagtccttttaatttctcagcaaaataatctccaactttctttgcatttccagccaagtcgcgatcgatcagttcattaacttctgctaatgctgctgcacagctgactggatgtccaccaaatgttgttccatgagatcctggtgtaaatgctttagcaacttctgctgttgcacagattgctccgatcggcattcctccacctaagccttttgccatggatacgatgtctggtttgattccatagttcatataagacatcactgcacctgttcgacaccatcctgtctgaacttcatcgatcaagagtaacatatcattttcatcacaaaattctcttaatcctttcatgaattcctgtgttgctggatgaacaccaccttcaccctgtactggctcgatcatgatcgcgatcgtattttctgtacatgcatctttaaatgcctgaaggttattgtatggtgcatatgagaatccataagtcattggtccaaatccgacctgacatccatttcccggctgtcctgttgctgacattgctccgaatgttcttccatggaatcccatcttcgctgttacgatatgataatggtttggtccgtatttttcgattccgtatttacgagccatcttgatcattgcttcatttgcctctgtaccagagttctgatagaaaatcttatccattccaattgtttcacatactttttcagcaagcagtgcctgaggaattgtgtatggatagttgaatgtatgcatgatgtcgccaacctgatctttgactgctgctacaaccttttcattacagcttcctgcgttatttactgcgattcctgcatagaagtcgagatattcctcaccattttcatcgtacatatacatatcttttgctctctctgcaaggaaatcaaaacgttcgtatgtctcgatcatatatttgtttactttatctttaatatcctgacttgttaatcttgtatcttttaatctcatatctgcttcctcctcatgatgttattggttatttaacttctctgggccagattttgtttatctttttcattgataaactttaaataataaaaagaaaagcaagggaaacttatcctgttggtaagcgcccttgcttaatttctatcctttattttgtacaactatacaataacactggaggattgaattgtcaatatatctttgttattttttgaaatttctttatttttatcttttataatatattttattattatattgtatattttttcttagtgttttattgttttttaatttttttgtaaaatattatatattacatctgtccattatattaaacatatcattttatcatcttactacttccgtatgatacttaccgataatctacaaacacacagataaaacttgtcttttgttgtgtttcatttttataattatgttttttatctgtttcaaatcgatagatttccccttttgtgatcttctgaacatcttcaccacactcaatcgtaagttctccatctgtaactgaaagatattctcttgtcttctctccatggctgccactgatatatttaccccctggttcgatatcaatgcggtaaatctctaattggtgattatcttcatatggaaaacatgtccatactttgtattcaccgatcatttcttttgttggtgtcatctgatctggtgttacaaggcaggattccattggcggagcatcaattaattcttggaattcgattcttaatccgcttgtgatctttcctaaaacacctaacgatggatttgctgttcctttctcaatctgagctaacatacttttactaacacctgtttgttctgatagtacatcaagactcatgcccttggaagttcgaattctttttaggttgacagctacattgtgagataggtatgattgataatccatagaagactcctttttgcttttattatcagtttcttcatttctgcgtattctaatgcaagtattattactatccttatgttatctgcaatactgctttaatgcaagtgcaattttttacataaccattcctttttttaatgcaaacagttgcgaaagaaagaggtttttatgtaaaagctctatcaaacgtctattcaaattatgacgtttgatagagccttgtctttctgctgtcatttcgttataataggattaatcgaacatatatacgggaggaattttattttggatcaattattatgccaattaaaccaggaacaactagaagctgttacatctacagaaggttttatccgagtgatcgcaggggccggttctggaaaaaccagagcgttatctcacagatttgcctttttggttaacgaaattggaattttgccaggcaatatcctttgtgttactttcacaaacaaagctgctaacgaaatgagacatcggattcataatctcattgctgataacgatactggttatattaataccttccatggattttgtgtatccattctacaggaagactcccatgccgtacaatatccaaagaattttcttgttttagacaatcaggatattgattctatgttaaagatcatttatgaggaacgcggacttacacttcgtcataagacattttcaaaggcaagagatatgatcgagatgtataaattagaacgatatcctaattattatcttgatctgatcacaatgtcccttgatacattacggcaaaaatattttggggctaccgatgtgaatgatatcattttttatggatatttatatcaggagaagaaatgttttggtctcgattacaatgatcttttgaaattttctctttatatttttgaaaagaataaagaaatccgtttaaaatggcagaaacgtctggaatacatcatgatcgatgagttccaggatattgataagattcaatatcaattaatgaaagtcttatgcggatatcataaaaacctctttattgtaggagacccagatcagacgatctattcctggcgtggtgcagatatcaactatctccttaattttgacaaagctttccctgatgttaaaacgatcatgatgaatgaaaattatcgttctactcctcagatcttatcggtatgcaattcactgatcgataagaataaaaatcgtatgaaaaaggaccttctgccaatgtgtcatagcaaaaattcagtgctttattatcacggagatacttcagaagaggaatctgattggatcgcagatcagatcataaaattacataaaaaagatatctcatataaggatatcacgattctttatcgtgctcattacgttacccgaaccttggaagagacattgttaaaaaagaaaatcccatatagcatctatagtggaattcaattttttgagcgaatggaagtaaaagacgcactgtcttatctgcgtatgatcacatacaaagatgatctctcttttttaaggattgtgaatgttccaaaacgaaatatcggtaaaaaacgaatggaatttcttcaagcatatgtaaatgctcatcactgttctttttatgaggcattaaaagaatgtgtggaagatccaatttttaaaggaacagatgcaaaagattttatctcattgatcgatgctttttcagtgacttatgagcaacgaacaatttctgaagttttatctgatattttggatcgaagtggttatgaagaaatgcttcgaactactggaaatcaggaacgtcttgataatctggctgaattaaaacaagctgtttatgattatgaaatatcttgtggcgaggaagctctgctacctgattatcttgatcatattgccctatttacgaatagtgacgttactgatgattctgacaaagtaaaattgatgaccgttcatgctgcaaaaggattggaattcccacacgtattcctatgtgcattaaatgaaggaatttttccttccaagaaaacctctacaattgagggaatggaagaggaacgtcgtcttgcatttgttgcaatgtcacgtgccatgaaaagtttatttttaagtgaatcacacggaaaaaattttgatggatcaacccgttacccatctagatttattttagatatcgatcaaaaatttttagaatacgttaaaaaaccagaagatactctgatcgcagaaaccaaaaattacattcattacagtaatcgctatttagatggttatgtcactgaacaaacttttcaggttggtgataagatcattcataatgtctttggacaaggtaggattaaatccatcctttctgatcgaaatgcatatatgatcaaatttgaacaaatagaaacacctcggatcatttcatttcgggttccaataaaaagagcttaagttttatgtaaaagaatcctgagtaaatttttactactcaggattcttctttgtataaagaactaatcgtaaatatcctattgctcgaagtccatattggataaaagatgtactccatcctaatgatccttgtggattaattgatacacgtctgactgtttcaaaatctcctgtataaaaacataacatgtaatatagatattcgtcatcggttttatttaatagtactgttcctcatatgtaccattacagtcaggataagaagcagaacgatcagcacggttataaaaaccaaaactgccatggactgcggttgcttcggaaatcaattacagccagttttccagaacatcattcagcttattcatatccagcggtttcgcgatatgtccattcatgcctgtatttttggccagctgtacatcttctgcaaaagcattggcagtcatggcaacaataggcagttttcccttttcacccgaaagactcctgattgccgctgttgcctcataaccattcataacaggcatttggatatccataaaaacaagatcatacgaacctttcggagaagcttccactttttcaactgcgatttttccattttctgctgtttccacttctgcccctgtcatctgcaaaatttcaacaccaatttctctgttcaactcattatcctcaaccagcagaatccttttttccgtgtagtctgattctgacagcttctccaaataatttcttgctgttttttcttttcttcctgaagtaaactgccgcagtgtagccgtcagccgggaacggaacagtggttttgcaataaaagcatctatgcccgccgcctttgcttcttcttcaatctcgctgaattcataggatgtcagtacaatgatggtgatttctttacctatccgcttccggatctgtctggctgtttctatgccatccatatccggcatcttccagtctaaaataacagcaaagtaatcatctttcaactcatgccgtgcataacagcactcaatggcttccctgccagagagaacccattcacccataataccgatttcctttaatgttgcaactgtactttcacagcatgtcctatcatcatccacaaccagaaccggcagattcatcagatctctgtcctgttctttttctttttcctgaagctccagataaattgttactgtgattttagttcccttgtgcaaggtactgtccactttaatagtgccattcatcaggttcacaatatttctgctgattgccattcccagaccagttccctggactctggttgtccggtggtcatccgcgcggctgaacggatcaaacatgattttctggaattccggtgacataccaatcccattatcctcaatcgtaaattcatagcatccaagttctgaaaatccatttggcttttcctctatggaaaaaataatattcccaccatccggtgtatacttgatcgcattactcatcagattcacaaatacctgctgaatcctcaagctgtcaccacaaacagcctcatgttcaatatgattgatgtgtatatcaaaattatgtttatgttcatcaagcaccggtttcgtaattgtaataagattatctaccagatctgacagattgaaatcttcctgtgccagtgtcatttttccactttcaatacgtgccatatccaatacttcattgatcagccccagcagatgacggcttgattctgtaatcttgctgagacattcaataactctgtcctgactctcaatatttgctcctgctattgccgtcagacccacaatggcattcattggtgtccggatatcatgggacatattggaaaggaattctgttttcgcacgatttgcgttttctgcagaccgataagcctctttcagtgcctgacgggattcaatctctgctttcttctcctgtgtcacatccatggatgccagcaataccttttccagctttccattcttccattccaaaggaatataagaagcgattttataagtcttttcatccatgctgcaatactcaaacttataaatatcattttcacttttcagttttttccgaatattatccggggctatcaggatatctatagcttccaatggttccagtgtcttatatttttcaagaacctgcatctgaaaatcatgataaaatcccagaggtttatatatcatctgtccattcagattgtagaattcatatctgtcattttccagatcacagacaacaaagcggtcaaccagacgcacaatactctgaatcagctgctccatggaagcattatccgctgccatctgcagatgccgcgcactctccacctttgcctctgtgatatcacgcagaaagatcatggcatattctgaatcctctatttcgccacgtatgaccacattgcggacccatcgttcttctccattcagagtgatacggcactctaaagccaattcggtttccagacccttcagcctttctgcaatataaccacggtcgtaaaaagaggataccgccttcttatctgtctccacaacataggaatccacaaaatgccggatcagttcatcccatgtacgactctgttcaaaaactgtcatcagggacggttcaaccttaaaggtatcaaaagtattcgcttccagattcacataatactcgcacagatctgctttcgtaaaagcccggtggaaagcagcagatttttgtgcctgcatgatttcttttttctccgcatcaatgttaataaaaatcccggcaatcctgctggcagaaccatccagacggcgtattacttctgccgatgcccgaaaccactggtattgattatccttcattttcatacgatactctacctggtattttatctggttcgtcttatccttaattgccgcctgaagctgcatcattactctttctttatcctgtggatgcagaagatctgaccaggattccagtttattcggaaagtccagagtatcatgatagccgagcatttttcggaattcatgactccagtttgcattcacaatctcactgtttttgtcacagtcaaaataccagaagccggaatagatagcctcattgagcagtgccaaatttacatgatcccagttgacctgtacggacataacccagatctgtctgcccgcctcatctgtcgcatcctctttacaaagccgtacattattcactgtaccgtctgctgcaaggatctgtgcttcccctgttccgtgaagctgcaaaaaacggtctcgctccagtatatcttcctcgtcataaaaaaagtttctcaatgagccttttgtctgttccatgaaagtgtcgaatgtatatcctgtactatgcaacagcagattattcacagacaaaatagacaggttttggtcataagatcctgtcattatacctaccccgccattattttccagtgttttctgtacggcctgtgccatggcctgtgtctgccccgttacagtctcacctaaagaatatattttgtcttcataatttttcattttataaaaatcctctctccatcttatgccttcttcatcctgcttttatctgtatacagaaaacctgtccctgctagttttgttacccatttttgcatgcaaaaaggacacttgccaaaatctgccagtgtccctactatatttctctaaaatcacacatttatataatataaaaggtatcggaatcccttctgttcaaacatcttttccatatattatgatgatatggaaacaatggcaaccggctgacatggtcaagctttctgactttagtcccttctggctttgcgcccctacctttcaacaggtttgcttttaaaataatctctttcttcaaaagaccttaccacacgattttccgcacgtcaataatttttaaaaaaatctacacatattttacttcataaaaaatctaaatcgatgaatcctaaaaacctaacattttttcatataaagctcattcatcatttatagtgctattctctccattaactaaacataacctattgttcgataataaattttagatccaaaaagaggcttcacaccacgaaccaactcgcaatgcaaagcctcatcactcacccattatattcttgtcacaaaatccagcgagatccacccattccgcctggacagatggctcagtctaaactggacaagcggctctgccgcataagaatattcacaatccataaaaatgtgatgatgcgttcaaagaggataattacttaatcattttcattgcaaatcacaatcagatgacattagcaaattttctaatttattctgagcaaatctctgaagataaaaatacttatcaataattttataattcatatttctatcaatttgttcaaagcaaaagtctattaactcttttataaaactttcaccagacagataataatcctgcaagattatattattctctggaaagtgcagataattatagatatatttttcatcaatatcctgttcaatgattccctcacctgttcctggcattttaggaaccagtcccgcccccaaaatagatatatattcagggttttttgcaactattttatattttactgatgatatattttctaaaactgcttcagcaatataatcatctataacaatacgaggatgaattgctatttctgactccatcttatacgccttattcaccgcatctccaaaaaacatactttttgaagggtcaacataagcatcaccataagatattccacctctaaaaagaattctttctttaatgaatcgtaaaaatattggctcacaattacacaatgccactttaaatagttcgccctcatctttacgttcatcagatattccgtctttaaagccatagaaaatataagcacaatcagaaaatgtatatatttttctaaaatacaccgtgtgtatcatatcattttgcttgtttctttcaagctcttcatgaaaaattttgttaattttatatgtctcttgaaaatcaactctattttggcttccaagaatatctacaaatatgactaaatatttagcgaaaccatttgactcattactcatcaaaatccacctctactattgtcctttttcatttaacttctttattacgcaaagctgtatctgttataaacctcgcccatccaaatactgaatagctgttgaaatcaaggataagcatcgcttataaaaatactcataatgccttttatcctgaatatccgtttttgttgtttcatggtgtcgaattctaaaattattgccaagtatggtaagctcatgaaattccttttcaaataattctaaaaacggctgttgattattacccatatccattataatcttattaactgatttcttcttatctacagtcgatgaacagtaatatgtctttagtctctcaaatgcatcccaaagtttctccactgcaatttgcaaattgttttcatcataatattttgaagcctcttgtaataactctttcagtcctacttcttgaacagacactaatgaatttttatttatctgggtatcaaatgtattcattagcttccccttggaaagctgaaacggtatctcattcagttttaatatagcattaatctgtggttcaaagtcatctgagatactatgtttcgcaaaaaactctattgcgtccaacacgcaaaatggagaattagaaagtatgaatgcttgcaaatcagcagtttcaacatattcttttttatcattataacactttggcacataaaattgccttatttcattgaaaacatcctcagctactgttgtattataattccatcccgtttcgtcagtcgcttgatatacgatattatatcgctccagaaactgataaatttgatttctcgctttccgctttatggacaatactatcttttttgcttttatgtcctttgcatttcgttgagaatatggaataaacaacgtattatcttcttgctgatatattctccatccataaacatcacgattggatattttctcagcagggtaaatctcataaccgtcattttgtaatagcttgttaattgccactaaaaattctttccaatatcccttatcatatcgaacagcagggtgaaatacttcacaaagaaattttaaatatacttcatcgctaccatcttgtaaattgaatcttttgtcttcaaaaacccagcagtatggataatcatcattattcactgtatgttgccaaatatcctgttctgcatttgcaaatcttgaatcaaaacttggcattctctctaaatcatataatcttttaagaaaatctatttcttcaaggcgaccataataattgtaagtaacggttcgagtttgaaaaaattcatctatctccaatccattctgaaataaatctaaaatatctcgctttgttatttctgtaatacggttcactccattttcctcctttcaagcgtattcagcacttatatattgcttcccaaatattttaaagaaaagcgtatcactattttaatgatacgctcatcattattaaatcacttcaaaatgcttcaatgcatcctttattgcttcaaccttctctggagtcggatgcttcctcggctgtttcaattcctctaccgcattaggagcatcgtacatcggcaagcctaaatctctctttacctctgcgatatatgcggtatgtactttgaaaccgtatttaacttctatgtattcctttaccattttgtagatcgctcgttctttgggcttgtagctttccgctcttttagcaatattatcaagtggaacttttccctcaccctcgccaaactcaacttttacgttgatatgtccgtctggctttttgtgggaaagcagtactaccgtctcaacatgaactgtatttgagaactgttccacatctgttacccgcataacctctctgctgcctcaaacacttccaaatatctcgcaagacttatcacttatccgtaactcccctgctttaaattgtattctttattgctttgtatggaaattcaactgattgtctatgtcccgtccagcatacattactctaagtattgttacgacttttttatcactatttggaatatatagtatcacataattatctactggtaatatatgaagttcacgacttttccatggttctttttcatattttcgataacgcttcggcatcgcatcaagacttaatatctgttcttctagacgattaagttgtccgattgcattttctggtaattgtaattcaaaagcaatatattcaaaaatttctctcaaatcacggtctgcctgttcagatacttctacttcatatttcataagtcataatccttgcgaatatcagcaaaagctttcttcgcattttttgtccgtctatcatgcatatctgcatatcctttctccaattcttcattgaattctacttctgataatatgctgatatcaacaggtctagcggatggtatttttacttcaaatggaagtcctctctgtaagataatctgcttataaaacatattgatagcactagaagcaggaataccaagtgcagacaaaatactttctgctttttctttgacttctggttcaatccttgcatataaatttgctgattttgtagccatataaaacatctcctttcgtgagtagtttttctatctatttttattatatgcaaatgtccgcacaatagcaatactaattttacctttccgttttccaacagcttttatatcaccattccttgaacttattctatattgccatttacattttggggaatatatctgtatgacaaattaacacctataaattaaatgaatattttgtttagagtttttcgttttattctgattaatttatcattttactttgttaactgatttcttaatatttgcaggaccttaatgtcataagcagctctaagtttcaaaaagattttaacttaatatcagaaaaatcaaactggttttctagataagcaattatcttatctgataaactatgcatacaatgtaaatactcataataattcatattatcaaaacaattttcgataattccatagaaaggtttttcaatattttcaaaagctataactcctgcattttcaagattataatgcatcatacaattacgcaattttgttttaaataatttttcgccttgagaaagaattttattaatttcttctgtttctatacttatatcatcattattttcacaataattttttaaacgttccagtcctcgcaatgtataatatgtcacaatgtattctactctaaaagcccatatattcccatctataaataatggccttaatacatatttaacaaaattcatattacataataaatgcaaaaaaaatagattaatttctttaggttgcttttccaaaaataatcgatttttcttatttgtgtttatatcatagtaagaattaatttttgtagaaatgcatggtctttcaactaaaggatatttcaaagaagatgctatacattctctaattgattccgtaaatgtccctatttgataacttatttgagaatatttttctctatttttattgtcaaatatattctcaacagacaaaaaatctgctaactgttgtgtgtttccaataatatgtctagcattcatccaataagtccccaaatttaaatgaatattcttatttttcaaaaatttaaatctaagttgacttttaaaatcctgattttgttgatcatcaaccgacaaaaccctttttttagatttcccaaatctatccgagtaagctttaatgtgattacgaatatcttttaaatcttgagctactggttcaagtacatagacttttcccatatattcttggcatgattgaataaataatgcatagtatggtattatttccatacaaaaaataggatcctcttctgtctgtaataaagaatatattgactcagcatcttcttgtataatgccaatagaaactaaacgttcgatttctgttaatttatccatgttatatacctcttattcatatatgtgctgttgctcaatataatttcttaatgtctcaagaaccttaaatttctcctagttaatatttttgtcatctaatataagattcccttctttatctctaactgccttttcaagcaatatacttttacctccgtcataaccacagggatttattctgatttcctttttaatcatattttctccgaacatatcttctgtactataaacataatatcttcttccattataaataacaaatgattttaacggaattctattattatttttatcgtaaaaatttgtatactctttattaacatcttgccagtcacttttattttttatataaatccattttatacatggtatactaatatacaaagcagctatacaaataacagaactattattgttatatattttattttgttgttcgattaaattattaattccatataatgcataatataccgtatatatgatattttccaaatcatcaatactaagcaatattggaataataaaattcagataatgctctttatttcgataaatgtaatatattaataaccacaaacctcttgaaatgaatatccaatatataatatgaatatttataattaaagtaatctttaaattcaaaaaatttcttattcttatattccataatttaaacattatttttacacaacttatttcccattgaaccaaaacctgatttaaggacaaaaaaattattattaaagaaattacttctttaataaatttacatatttttttaacaaattgctttgatctacacttttctagaaataactgaatacagtctttactaatttttattactgtcactttttacccatttttatatttctattatttaatatacttattccttactctgattttttaatgtgtacgggacttaatatttattataagttttttccaatattttcaagttcttttatagaatccttgttttttgcaagttcatcactggctgttgcataatatgatttttggaaaatcatatcccatgaaagatatttcgccatgcagtcgaactgtttgtcaattaactcatactggatactatccaccggggatcctcccacaacgattgttccaacttttttatttttcagctgcaaaccgcggcagtagcacttatcaatgataagtttcaactgcgcagacattccccaccaatataccggagtagcaaaaagaatcacatttgcagcagtaattttatcaatcgtgggatttgtatcatcctgatcaatacatcctttataacattgacaggccccacatcccttacaaggtgctatatgaagtctgtctggttggatgatttcaatctcattcttttctgatgccccttttataaatgcgtcaatcgccgtcagcgtgtttccccttctggcacttccgttaataatcacaattttcatgtatgtttcctccagcttctgatttcatgaaatcattataccttttttcgcttatcctgtcatcacatttcatcagatcagaacctgtcaaaatcctcctgtgtggcggatatgacgcacatccccgtcaaactcaaaaagcagggcaaacagtgccagttctgcatccgagttttcaatcagaacacccttggcatccaacttctctctcagcacatccgtccggaaactctccggaatcagtgcaagttccagacctccgacttattataaaaaatcccggcatcatccagaactgtttccaccagagctcttcctgattctactgtacgtccaccttcacgatatcagaccaatgtattgcggtgtgcaaatggtgatttttcatgtgattcgtgtggaaaaatccacattttcctctgtgttcgtgtggtttatggggattttgttattatggtgttatcattcttctttttcattttttttattttttatctcgtttattgccttttttacaacattctttactgaattcccttcatattcattaaacaataactttttataattttcttgtgttatctctttttctttcacctttttccctttttcatccaagcccaaattcttccaatacaatatttcttctttttcaatatcgaaaaatataatcctgttattagcaattcccatatgataatattcaatcaaaacatcaaacatagcatctacataataatgtaagtttcccaaaacaatttccaaataaggcatatgctctccattatgaacaatcatatttctatttcgatatattctcataatttgccattttagtttttctttatgtctcattaattcttcaaaaactgtttttgaattgcaaaatatatgttttgaaaataattccatacgatattgtaaaattggatattcctctaacatatcctttaattcattataattctcctcttgcgcttttaatcccaatataaatgctaatttcataggattttgttcgttttcttctattttatcaaaaaactcttgcccttgtttacccaatacagttaatatatccttacataattgttccatttggttatacatatatgatctattcaaaatacttgtcaaaatattgcaaacaacatttattttatcttcatcacctgttctgaatccaaccaaagtttccaccgcagtccacaaatctaacaattgattggttgcttctttactatccaatgcactattatgtaaacttactgctctaaaaaaagattctggcggattaacattattcaacagctgatcatcaaaaaaatatgattgtatttgtgactcattattggcccttaacaatacattcttttcattcttaataacactactcgaaagtatatttagttcatcatcaacctgactaatttgcgctgttcctttaatatatattggtcgatgatgttgactaattctgtgtagaccaaccaccgtattaatataactatatgctttttcaacagccatgtaactatctatatcttctacaagtaactcagccagcatgtctccattatgttttaatcctagatcttttttcaattcttttgatggttttttgactgtaatattttttgtttgtttcaaaattctagaggtttccgcatttattccaaaaatcacctgatatgactttttctcaaacaaaaatttattgaaaaagtctataagttcttgttcacttcccgcaattgtttttcttttatccaaaaaggtatgtttcagttcatgacttatatattccggactatatccaccattaacaagctcagttgccaatattctagttgccatatatattctttgtaaaacttcaaaatttacattatcagaaaatatattttcaattaaaacatcatatattgtatgcagatatacattatcactaatctcgcttatatattccgctgcctctgtatatttattaattttggccttatagtcaaattttgtataatctacataattttttaatttatcccttttccccaagagcatttccttagctggcaaaaatttttctaaaaccatgtcatgtttaatggcattttcaaattcttcacttaatggaataaaatttccttctgttattgctttttgttcaatattctgctttgttcgtaataaatcatagcataaatagtgagaatttagtgctggtaatttataagactcaaaagaataataaaataaaacttcctccaatgtttggacaaacatgataaatttatttctattacatgatttttttatattattgtattctgattttttcatacagtttctcctttatcatatttcaacccttgccaactattttcttcttatctcggtcccataaatttgtcaccattcaaatgtatcatatgctctggcaattcagataaactgatttcttaatgtctacgagaccttaaatgtgtactggcaatctaacttttattaattttcaatgtaccatcctccaaaaaaggttttagttttacagatctttcaaagagtcgatctgaatgtcactagtaatctttggtgtgtatatcataataaattcctccacgaggatttattataatgtgattttgtacattcttaaatgatcatttttgtacattcttatgttatcatttataacttaataatattgcaagcagagtgagccgctataatacctgcaagtttactcgcgtaatgataccggatttcttaatgtctgcgggaccttaaattcttagtcatatttgatattaagtttctccttaaaaaaatattaagcttcaaaaaattgcatcccgtatccttcatttttttgaatatatgaaagcaattttttatcaaatcttttattcatatattcaaagattgctggacatacccagtattgacttccttcaactagttgtattcccatttctaaggcatcaacataatctgaagaatgacatttggtactatctatcattatcaaaacacttaaaaatatatctacaatattattcatagtttctatcaattctttatccttttctgtttttcctggatgtacataattatccgttaaatatttctttccattagaatgaacgtaattattcaattttctattttctacttcccatttatccgcaagaaaatatttaaatatatgctccacttttttattattaattattaagtatgatttatacttagatgtaccaaagaattttttctatcctttatattttctaaattatctaattcatcataaatccatttttccatcgctagttctgcttttaattttctttctccgttaataagaatttcaatatttttatttattacttttaatataaattctggttctaaaggatattcttgaaattctttatctgataaaccatgtttattctgtattacgtttaaaataaacaaatattgcattaaatcatctctaaactttcgtattaatgtatacccatctgaatatgcatttctatcacaacaaaaatctattacttctattgtttttaataccgacatcattgtttcacaagatattgtatttgcaccattctttccataagacaattctattgatgaaaatgtattatttgataagcaattaaaaatatgccaaatattttctatgtctttatatttaaaattataacttatatcttttaattccatatatcctccaataataatatttgttattctagctctgtgatttcttaatgtcccttattaaattcttctatcaatttctgaaattcttctaacgacatcatgctatacattcttttccaatactttttttggaaaattactattttatgtacggaaaatctacaattttttattatcaaccaacgatgttgctttttaatttttttatcgttttcctcttttaatgacattctacaaaacaacatctcatacttagaatataactcaagagcatattctaaaggtataattaatattaaataaataattggaatcataaaaccaattaaggaatcaactatatttaattgtttatattcttccattccaatttttatagttttatacaatatccaaaatccacctattgttaatacagtttccaataatttgcgtattttttcatattctttacttttttccaagaacatatttattattgatattactgtaactatcggaataatagctaactcaatccaaatgttaaatgtaaatgtgctcataagaaattcaataaaaattgatgcttttacattgtcctttaaaatcttacttatataatgctcatctgcttctgtcataatagcgttcacacaatacattaatcctgaaaaaataaaccaaactacaatatcctttatataaatattcttccagaatggcatattataaaatatcaaagttattactaatacataaccaatactgattaaccaaagtatacacaatcttttagcaaacatggattttataacctgcctaaatgattctctaatacttttttgacttatcataaacacaaaaataataaatccccaaattactgttgcctattctcttgttgacaaaatatccatttctctttctccattctactcagtttaatgtgaaatagtccttatgcttatgaaattatacagcaaaaaaatatactcaaacattaaatttttctttacgtgctttgtcctattttatctaaagaaatccatttttatacataatatataacctatgcgatgctgcttttattttacgagtactgatgatttataaaatttcttaaaatcttatagcctttaatgtcatgactattaattatcttcaaacaccactccaaataattcttgtaaagttttttgaaaagcttctctatacaattttagaaattcttcattatatctttgttttaatttcccatttaacaaattttttataagttccgaagcttcttcatctgttctcgctattaaaggaatatataaatagttagtttttgaaaattccataacaatttgggctataaactctttatcaacataatattgtagtaatatagctgcaacattaacattagagatctttgccttatctgcaatttttctaaaaaataaatcgtcgcatagaaacgtcgccttttctttctcgcacaaaataagtgcatccaaatgaatcctatgtaatcctattgacgaaactaactcttctccatttagatccccacctattgtataacctatcctatcatcgtcgtttatattatattgtcgacattcagcacaaaaatctataattctttcccaaatttccacatatgtaacatcataaggtataattgtaattttcccacctattgttactaattttccctcggaaacattttctcttctcttcgtactggaatatctctcctgaaaaaataaattatagctatcaggtataatcaataaactttttattttatcaagaatattaagtaaattcattgaactcaaaagaaccaaagtcgataatgatggtacataacatgaagctccttcttttttatagatgggatatcctgtatacatcgcttgatccttaccataaagcaagaaattcaatgcatctatatattcatcataatttccattcacaaaagaatcaattggtaaccctatattgttttccttaaaatgatataagtcaagaagattgttcatatattctgaacgatccgtcagctcttttatttgatttatcatatcttcgggatcttcactagaaatcatatgtactacaccttcaaacttttcaggatattcatttattttgttaaatacaaaagctgctgcttcattcatacgattttttatttgaataattttataacttacaccgtcaatttttaatatttgattcaaaccacttccaatcagtttgatatatagtggcatttttctatttacatgtcgaatatcaagactacaattatccccgtcaccaaattcgctttctgaatcaagacatatctctatcgttttagcattttctatccctgttattaaattctcctttaaagttaccacagtatttggtgcaacactttttatatcttcatctaaatgataatgacttaaattatgactataaaatcccaaatacattttataaatattaaaatcatcttcaccgtcaagacaatataaagccttatacgcatataaatcagcctctgctgtttttcctaatctaatcattgctaaagcaagtgtcatacaatgcaacggttcctcagattttcgtaatatatctatatacggcatataaacattttggtctgtctcattacgttcaaataacatattaataatattacatgctacactttcttcatgagaaacatcaaacaattcttttgcgtatttcaacatgctaaattttttttcttttattcgtgcacacaaatatttaatctgtaaaaatcctttccgtaaaatattttgtttcaaaaatctatctgctatttcttccacagaatccaattgattaatccttattaagttttttttataattattacatacatcaaacaaaaattttaaggaatgaatcttcaatttatctggttatgacatatatttctgatgggatgcctttacattattctgatttaccattgcatattgcatcgttgtatcaatctgtgaatgtccaagaatcttttgcacttgttcaattggcattcctttgtcaatcgctctcgttgccattgttcttcggaatttatgcggatggattcgttccaatccaagctctcttcctaattgtcttaatcgaatctctaccccactgatctttaagcgatcatatggtgcatctaaagtaacgaataatgctgggttcttatctttcctactttctatatattccattaaatgtacttttgctttcgcatcaaaataaactcttctttctttatctccttttccgtatacaacacattctcgttcttcaaaattaatatctcctatgttcaaatttaccaattcacccacacgtatacctgttgaatataacagatcaatcattgcaaggtctcgaatctgtgtacaatgatcccttaattgttcgattccttcatctgtgatcacactttttaccactgtttttgtcttaatcttatgaatccttctcattggactttttaaaatgtaatcttcttcctccaaccatgtaaaaaagctcgatatattccgtcgtatattatcaattgtaacattcgagcagttattccttttttgataatctgcaagatatgacctcatttcatctgtcgttatcttgcggatttctttttccgtttgtgaaagcatatgttctgctgttaccttataatattgaatggtacgttccgaacatccttctactctttttgcatccaagaacatttccagaaattcttcattcgatatctgttgtttctctagttcattttctgaaaatgtccttagaattacttcctgtaattttttcatctgtggcactgttaaatactctgccatctcatttagtattgttacaattttctcttccatgttggtacactcctatataccaacatccttcaaccatttttgctcctaaatctatgaaataaaatattgacattcctgataatatgtttcagcttctttttgcattaattctaataattgatccactttatgatgttctctatattcttttagtccttctaaatacttactgcgatcatcatctaagataataaatggttttaactcatcatatttcaagctttcccgaaacaatatcattcttcctgttcgtccatttccatcctgaaatggatgaattgattcatatcttgcatgaaattcagcaagtgttttcatagttttttcttgtttatgataccaatccaaaagttgcctcatctctgcttctacatcctttggcaatgctgttttatacattccgatcatattgggacgtttcttataatctccgattgcatatccattcgctcgatcttcaaaaactcctgatttcaactcataatgcatgcgttttattagattctctgttaattcttcttccaatgtatctaacatatgattaaacattaagaaatgtccattcatttcctctacatctttggctcgataatagtcatcgttgactggtaatgttccattatcaaatagtgatgctgtttgttctggtgtcaatgtacttccttcaatcttatttgaattgtacgccattgctctttgcgtataagcataaactcctgttctgtcaaatcgttttcgttctattttaaaacgttcaattaaccatcgtttaaattctgacattttaatatcgcctcttttctatccgaaatattcttgcattaatgaatcatatagtaattgtgttttttctaatgatttctgaacttcaaacttcgatttgtctattcgttcaagaaacattagatacttctgttgcagatctattggcggaacaatcattcttctttgtttcaaagaattaaactctatgttatcagctgttacagccctaacaccagacaaaatatctttttcttgcatcttaaattgaacagctaaaaacctcgtcaaaattctttctcctggtataaatacttttaaatcttgattaactgttataggaactttattcactgcaactggcaatgtatgttttaaaattccacttctaataaccataattactgaattcacaggaaccaaacgtgcagtactattatctacacctaattgattaattttaatctgactatctttcaatacatctgtcttcatgtctttagctgatacccatggtatatcgccatctttataatattctggatgagctttagaaggtgttccacctccatatatctctttgcataaattttttactgtatctgtttcccattttttatcattgtatacagcgtcaccaaagagttctacaaatcgggcttggattaaattatctaataaatttaattctttttttgctttttcccttatttcgataattttattcaattgctgtactatttttttctgttctactatatttcttaatggtattttcatttttttcattgcagtttgagtaagtttttttcttgttgcaccattaatcatcccatcaaccttataaaacataagcgaataacataaataatcaacatctatttcctctttaggctttagtacatgtgcatgattatttacccaacattttcctgaaactctgtatgctataggtttctcttttgatccaaaattaccaccatcttcagctaataatactagctcatcatcaaaaatgtaatcattcacataatcttgtattccgtttgcaccataatatggatatttaccttcttttctatctgatgccgttatgggaatcctcattgaatccaaaatttcacaacattcttcaacacgtgtatatttcaatttttccattcttcgttccttgcaaaattcaaatttataaatattaattaaaacagaacgattaattttactcatattatcaatataatttaatacaagctgtaattcattcaatgcatgccctttaacaagtatatatataagttctgttttttccggtaatgataaattatcaattgatctacgatttatcataactttccattttggaaaaatattatctttaattaagtttatatcctcaatgcctgaagcaattgatataagatcttgaatattattttcacaaaatttgatatagtcaactattttttgttcataaatctccctattaacatgatacaatgcagtaaaataaagactattaagttttacacttctaatatcttcaatagtattttcaaaaacggctattgcttcttcataactacctgtaaaaattttgcaaatcatatatctaatagcaaccgactcttctatttcccaattcaatgtttcatatatattaactgccatatccatattaccatttaattctagacataatccgtagaaaaacttaactgaattatcattttttacagagtcttgttgtttttcatattctacaattgcattctccaaatattctttatcatttaaaccaatattatacgctgtttccaagcgaagaagctcaaccattacctcatttgcaatatattgctctgtctcttttaatgaatcaagtatattaattaattcaactaatctttcagcattttcgattccttctaatcgccactgcacattaatctttttaatttcagcaaatgaaacataaattaaatattgttctgtgtgctttttttgatataaatcatttaatatataaaatgattcatcatatttctgcaaattgaatgccgtaagcccataatataatctaatagtatctgttacttctaatgattcatctgaaagaatctctttgcacaacgaatatacagatgcccataattgaacagaaaacattttatcaataacaagcaactgtatctctatacaatatttgcctaatgaatatgcttttataggttccggattttttaaataattttgaacccattcaacatctgatttaatattgtctgaaaaattttccatgtattcttctactgatttaccgtcatgtaaatcatctagtgctttataaaaatataatgtttcagaaccttttacaccttctaaattatatataaaaatattttgcagttccactttaagcttggtaaaattcatttcagcaatatacgctttacaagtttctatcttttccaaaacaagactctctaacaaacgtaagtctatttttttatttgttttaatattatcttgattaaaagaaacttctcctccatcatgcactactattcccgcatatatttcgctaattgttagatcatctggtccctttctttttaagaaaaaataatttgcaatatctttatgtctcgccaccatatctaacaattctgtattagatataggataaatttctattccagcatcttgaagtattttttctattgatttaaaagcttttgaactcgtattaattgtctgattgcagaataaatatattacatccaattttccttcataatattctatagctttttttgatgattctcttatttgagaataacctactctattttcaaaatatttcgactgaaaactaatttttcttcttttaacataatcatctcgttttttctctataactggaataatttcaactcctggatgattactatctgaatgaagtatcgtgtctttttcaacaaattctctttgaaacaaacgtctagttaaactttcaaaatttgttgttacatcatcattacacacagcaaactgtgcccatgtaatattaggataatgcttatcttctaccgccatgtgtaaaatcctcctataattaattttcacaatctttatatataaaaagtatattgcataaaattatttttatacaatatactttttgtttgattttaattaatagtaatctgtcttgcacgtattatatatttataaaaatcagctcgtgaacatttgttcttttttattataccaaattacgcctttaatttcaagcttaagattttaaacttaatttatgagccctcatagtctagctaacgcagcaatttcttttctttccttgtcatttaattgaaaaattaaatgatatactttcattgtattttctgtttctggaacaatgtgttcactaataatcattaaagtattctcccctccaattcttttaattttggttggctgataggttcctttcatcctcttcaaatcattttctattttatcaaatccttcttttaaagacatctttctatttagagataatgtaattccaaatttaaaatcttgattcaaatatcccattaactgttcatattgttttgtaaaattttcaatatatttattctccaacacagcataatctgtaacatacccatctttctctgcgtatatatataaatctgtctctcctaattttttattggctcgtccaattgtaaattcacgtgcaatcaatacattatatttactattcaaaggtccagtaacagcatcttgaatatccgctgtaatttccacctcatctcttttttcaaaatgtacaattcttttttgaaaacgtttaatcaccgagattaattccattactattttctctgataacgaactacagaaatcactatttttctcatatcttttttctaaatatctatctctcaaatcacattccatcaaatcaagataatcatcaaggttaatctgaaaagccatttctaataactttggattattaagatataatagtaccatatcattcaattgttctggtaaaaaatcatgattttgaaaacatatattataatatttttgaaaatcttgtatccattttaaattttcttgtccatcatcattatccaaatcttttataaggctatcatctacagggtttattattaagtcatcctcattatctgcacatttttcccaccaatctaatattgaatataataaatattcatatttaggctttataaaatctctaatatttgttgaacaaataatctcatataattcataaactgaatttctacattcttgtggtttcctcataagataatcccttggaaaaaatccatccaggtcaaattcttgatctaattcaagaatatctaataatgaccttactatgtctcgcaaattactattaacatacttcgttattctcaatccaagatcagataaattctcatagtctactatatctatttgaatcaaactactcaccctttcttaacaaaaatcgtctatctacttatttatatacatattcatctgattattttattccttttggacatttcttaattccatcaatcaacccaacatctgctggcaaccattcaacatccatcaattcatccttccccaaccatcgagcagcctcatgttctttcaaaactaagtttccactaactacagaacaccaataacaccccatagacaaatgaaaatccggataattatactctattgtatcaatcaattctccaacttcaatctctgtatccaattcctccataatctccctcttcaaggcttcttgtggcgtttctccttcttcaatctttcccccaggaaattcccatccacctttaagatctccatagcctctctgtgttgcaaatattttatcattgtctcttataactgctgccactactctaactgtcttcattttattttcctctttattcactcgtaatatattcatataaatcttctctcactggtacatctaataaccaaagaatttcaaccgctgttttctctgtattaggcattataaattcttgagcttgtcctgttgctgtcattcttcctaaataataaaattcttttgagatcttatcatccttattcttacggacaaacaattgaacatctatacctctttcttttgcatgaaggaaattttgtacatcttctgattctaaactccttccactcttagaaattgcaattaattgattctgattgacaaaatgatcttcatattttgttgtgtcgctaatattatctgctttatcataattgataaatactgggaatgtttttgtttttttatcgaatttatatccaccaatatttaatggaacttcaccattctcccaatttaaaagacgacatacatcttcataagtatatttttgatataacactagatctgtatcttgatatggatcactataatcacgttcatatcttgatttcccaaactgaatcaaatcttctaaaagatttgtaaattccatattttctaatactttttcaaaagatttactaacactatattccttatatcttgatatccaatttcgtgaatatgcgatcgctcgtgtctccgtttttttgtacatatgatctgtttgctgcttttcaaatatttgttgatcttcttcctgttccataagaatacattctttatatgtcttctttccagaacctgttggaaattcatttgtcattacatttatgatattttgaatactctcatcttttaatattatttcatatctttcttttaaattattttgcaatctgccgatcaatccatgcctatattcaatcatcaaagataataattctaattcatgtattcttttcccatttgcaattttctttgaaataaattctattattttctcttctttatcattcaatcgtaccgtatactctttttcatatttaaccaaaaacttataatatgagccaagattactattatcaaagattctacatacgtccatctcgccatactgttcaaattctgccaacttaggaatacgtcccaatttatttttcaaattaaaataattttccttaattaattttaaatcactaaaattagcagcatcaatcgctttataaatctgctttttactaatttcatcaaaatgtattgtagaactacctggaataattctgcttccctccattatataacgtcgtacattatccttgttataactacgatccccagacaaagcaatcggtatcataaaattattcttataatttccaataaaatcaagtatcaccacatattctttgtattctgcttttcgaagtcctcgtcctaattgctggataaatacaatcggtgactgtgttggtcttagcataattacctgattaatttctggcacatcaacgccttcgctgaaaatatctacagataaaatgtaatctaactcattgatatcctcattaactaaacgttcaatcgcatctcttcgaacttcttctgaatctgcgccacttaatgctaatgtacgccaaccatgttcattaaacttctttgacagttcatttgcttcttcaattctactacaaaaaatcagaccttttactcgattaccactgtaaccataatattctgcctgttccatgacatattttacacgatcatctgaagttaaacgtctaaaattctctagtttttgctcttttgtcattttcttatcattgactatcgtatcatcaataatttctaaatcggtaattccaaaatagtgaaatgggcacaataaatcctcttccattgctttttgtaatcgaatctcgtatgcaatgttgtgatcaaagatctcataaatattacgaccttctatatgatcatctcttttatcaggtgttgctgtcattcccagtgtaaattgtggagtaaagtaatccataacttttttatagctatctgctgaggtatgatgagcttcatcatagatgcaacattcaaaatgatctcttgcaaatctttctaaattttcttttttagacaatgtctgtactgttgcaaagataaaatccgcatcataatcatgagatttgccagtaactaatcccattttaacagacggtccaaaaaccttttggtatgactttaatgcttgttctgcgatttgatttctatgtactaagaataaaactttcttatatcctaactctcggacagcaaatgctgatgcataagtctttccggttcctgtactagataatagtaaagccttttctattccttctgatctcatcttcataagattattaataaaagctaactgcatcttatttggttttaatttatagctttcgaaatcaacaatttgttcttttgctgcttgtctttgttgctttttgataatttgattttgtaaatattgccctttataatcatcaatgaattcttcatagtattgactatttggtgacatccataaattcttaaattcatttaaaatttcttgtgcaacttcgccttgttctgtggaaactatctttgtattccattctctattttttgtaattgcactggatgtcatattggaacttcctataataattcgatataattcatcttcacggaatatatatccttttgtatggaatcctccaacctcaaaattcgttcgaaacatttttaattcaatgtttttcagttgagctaatcgctctaatgcttttggctgactaaatgttaaatagtctgtcgtaagaattttccctggaactcctttttgttctagttcttttaaaatcatagatagagattcaaatccactatcagtgataaatgctacactgataaaaaattcatcacatcgttttagctcttgttccaaagaaacaagaactttctttccctgtttatggtcattatatataaattccggacgatatgctaaatttgaattattggattgatttataaatgcagttgttaacccttccattaactcattagattttgaattctccatgtactttcctcttttctttaaaaactaatcttattatactatgattaacctcgatattctataaatttattttcataaaaaatactgccacatgaaaatgcgaacagtattttacgatttatttttaattcaatttttactactttttaaaagctttactaattacctttcccatcttttcttcattactatctatgccatactgtattttattcaataaatcttccattagtttctctatttccattgcatttgttgaaagcgaaccgtcaatatttgacccgtcaaatttttctccataaagatttccttctttaattgaatttaaccttctttttatttcacttatttcagaattatatctttccaatatatcatatcctaattgatcttttttattcataatattctccttctatatcaatattatttactaaattttataatttatactttaaaattctatatatcaaaaaggacatacacctaaaatacaaggatatatgcccttcaaacactcactaaaaaaatatcaaattaactctaacaaagaatcaatcaattatttcaactgagcagcaacctcagccgcaaagtcttcttctttcttttcaataccttcaccagtttcaaaacgaacgaatcctttgattgtaacattagctccgtttgctttagcaacctgttctacgtattttccaactgcctgttttccgtcttcagctttaacataagcctgatctaacagacatacttcttttaattctttgttcagacgtccaacgatcatcttttcgatgatgttttctggtttgtctgggttttcgttcatagcctgaacttttaagatttctgtttcatgctcgatgtaatctttagaaacttcatctctgcttgtgtattttggagaaatagctgcaacctgcattgctacgtttttagccatctctttgatctcgtcgttaactacgtctgtagcaacttctactaatacaccgatcttaccaccagcgtggatgtaagatgcaacaaatccgtctgctgcagatactttagcgaatctacggatgtttaagttttctccgataacggcgatcttaccatctaatgcttcttttacagtttttccagcttctgctttagattcttctgctaagaatccttcgatatcagctgcttttgttgtaagagcctgatcagctacttctgctacatatgttctgaatgtatcattcttagctacgaagtctgtttcagagttaacttcaacgattgctgcttcttttgcatcttcagatactgctactgcaacaagtccttcagctgcgatacgtccagctttctttgctgcttttgcaagaccgttttctcttaaaaattcaactgctgcgtccatgtctccgtctgtgtttgtaagagctttcttacaatccatcattccggcaccagtcatttctcttaattcttttaccattgctgctgtgatagccatgattctttttcctcctaaattgaaagtgtgaataaattattcagcgtcttctgcaacttcttcagagtctgcatcgattccctggtttgcttcgataactgcatcagccatagcagatgtgatcagttttactgcacggatcgcatcatcgtttcctgggatgatataatctaattcttcaggatcgctgtttgtatctgcgattccaacaagaggaattcctaaagtatgtgcttcctgtacacagatgctttctttcttagggtctacaacgaagatcatgtctggaagtccacccatttcttcgattccacctaagttcttctgtaatttgtctttttctttgttaagttctaaaacttctctctttggaagtacgtcaaatgttccgtcttcttccatctctttgatctttttcagtctagcgattctagattcgattgtcttgaagttagtcatcattccacctaaccatctctggtttacgtagaacattccgcaacgttctgcttcagcctgaatagaatcctgagcctgtttctttgttcctacgaacagaatctttccaccctgtgctacacaatcttttactgcgttgtaagcatcgtcaaccattcctacagatttctgtaagtcgatgatatggataccattacgctctgtgtagatgtatggtgccattttagggttccatcttcttgtctgatgtccgaaatgtacacctgcttcaagtaactgtttcattgaaataacgctcattttaaatctcctttagtttttgcttccgctattttcatcgttctgacaaacctcttgggcacttaccagaattccaatagcgtgtttatttttacctatgacagtatatcaaaccttgtccttctttgcaagaactttttctttaattataaaagaattaatcaagctttgtgatctcgtcaaatataaagtcattcactaccttaatatatgttcccttcataccagaggatcttgtctcaacaactccggcactttctagtttccttagtgcgtttacgacaacagatcttgtgatcccgaatctatctgcgatcttacttgcaactaagactccttcattgccttctaattcttctaagatatggatcactgctttgtgttctgtgaaggataacgtactgatcgcggaatcaacgattcctttctttcttcgttcctgttccacttcttcgcttacagatcttaacatttcaagtccgacaacggttgttccatattccgctaagataatatcatcaatggaataattttctctctggcggtacataaataatgttccgaatctctctcctgcgatatcgatcggtgcgatgatcgcatagtaatcatcaacgtctgactcaaatcccagtgtggaaaggctgacattttcattggtggaaagaatcgttaatagtctttcatttaatgaaaaatcaacataatctttgacatttcctgagatcagctgatgaagcacttcgatgtggtctgcttcatttttacctaagatctttccttttttactgatgacaaggacgtttgaattcattacttctgtcagaactttacagatatcgttaaatacaactttctgtgaattgttattatgaagtaatttattgatctttcttgttttatctagtaattgtatactactcatctatattttttctccttattttgacactgactccccagaagtctctttctcttttgcatcttctggcatgctgcatacgaatccacattccttgctagagcatacaagcttcttacctttttcgatcatatagcttccgcatttttcacatttgactgtggatggtttctgccatgacataaattcacattccggattattttcacatccgtaatattttcttccttttttcgttttctttaagacaacttctccgccgcacattgggcatgggattccgactttttcaaaatgtggttttgtatttctgcattctgggaatccagggcatgcaaggaatttcccatatggtccgtacttcacgaccatatttcttccacattcatcgcagataacgtctgtgacttcgtcttcgatcttgatcttctctaattctttttctgcattcttcactgcgatctcaaagtctgggtagaagttttcaatgacggatttccaatggactttaccttcttctaccatatcaagcagaccttccatcatcgctgtaaagttcacatcgacaatacttgcaaatgctttcttcatcatgttgttgactgcttctccaagctctgtgacgtataagttcttcttttctttgacaacataacgtcttgctgtgatcgttgagatcgttggtgcgtaagtacttggtcgtccgattccaaactcttctagtgtcttaactaaagatgcttctgtataatgagctggtggctgtgtaaaatgctgttttggctctaaatcattcaatgtaagtttggtatcttcatcgatggattttaacattacatttccttcggatttctcattgttaatgttatatacagataggaatccatcgaaggcgatcttgcttgcggatgcattaaaacgataatctccggcagcgatctttacagatgtattctcgtatttggctggtgccatacggcttgccatgaaacggttccagatcagctggtataaacggaactgatctcttgatagttcgtctttgatgcttgctggtgagtttgtcatgtaggttggtcggatggcttcatgtgcatcctgtactttcttgtcgtctttcttggcaacagttcctgctccaacgaactcggctccataagcttccttgatatattctttcgctgcggcatcggcttctacagagatacgtgtggagtctgtacgtaaatatgtgatcagaccgacggttccctgtcctttgatattgacaccttcatataactgctgtgcgatacgcatcgttttctgtggtgcgaagtttaacttgctggatgcatcctgctgaagagtacttgtcgtaaatggaagtgggctcttctttaatcgttctgtgactttcactccttcgacggtaaattcttttccttttaaataggataagatctcattcatctcttcttcgctgtggatctcgatcttctgttctttattgccgatcagtttggcttctaatggctttttgcttcctttgacatctaataaggcttctaaggaccagtattcctgtggaataaacaggttgatctcttcttctctgtcacagatcaggcgtagagctacggactgaactcgtccagcacttaaacctcgtttgatctttgcccagaggatcggactgatctggtatcctacgattcggtccagaacacgtcttgcctgctgtgcatcgactaaattcatatcgatgtctcttgcgtgtttgatggagtctttgacagctgtttttgtgatctcattaaatgtgattcggctgtagtttttgttctccagttttaatgcgtaatataaatgccatgagatggcttctccttcacggtccgggtcagtcgcgaggtatactttgtctgctttttttaccgctttacgaagagctgctaatacttcacccttcccacggatcgtaatgtactttggttcaaagtcattctcgatatctattcctaaggtactctttggcagatcgcgaacatgcccgttggacgcgatcacttcgtaattcctgcccaggaactttttgattgttttggctttcgccggtgattcgacgataactagatattttggcatatagtattaccccttgtttacatttttttgatatataagttctgatggatctgtttaatatatcctttcgcttctaattgaaataaagcttggatcacttcttcataagaatcttgggatgtacttaagatctcatcaatatatttcggtttcaaactcaacatatcatacacccttttttctgcctttgcaagagattttgcactatgctttggaaattttcgtgaaaatcccgtgaattctgaaaattctgttaaaatatcgtcgacattttcaactaattttgctccttgtttgatcaatccatgacacccttgacaatgtttgtctgtgatcattccgggaaccgcgaacacttctttgttctgatcaagcccgcaatccgccgtgatcagcgatccgctccttgctctggcttctgtgacgaggattccatcacttaatccactgatgattcggttcctttctggaaaatgccatttgagcggttcactgcctggcggatactcagaaataactgtctgattcgcatacatgtcataaaataactgaaaattttcttttgggtaaatgagatcgatcccacatcctaaaaccccaacagcctgtccttttttgtcgattatttcacggtgaaccgtcccatctacgccccttgcgagtccacttacaatctgtacgccttgctgagccagctcttttgcgaacttttttgagatttcgaatccataagttgtcggatatcttgatccaacgatcgctattgacagttctttttcttcatatggctgacctttttgaaaaatcccatacggagcatcgtagatcttcctcaatcgattcgggtaagcagcttctttttgaatgataaaacgaatattttcacgatacaaggcttcatagcctttcttgatcgctgtttcatctcttgaatgaacgaaacgatcgtattcaagttgtgtcatgtgttgttttaagattgctgggttgatcttatagagttcttttggatgaatgaagatatccatcaattctttttgcttcttgatcggcaatcggactttgccgcatagccagtaccaatataatttatcttccatattcaagcacctctttgataaatcctgtatttctgaaggtcatggcttccatcaggtggatcggtttgatctctgattcattttccataagcatgatcgtcagggctacttttaaaatcttatccattcctcgccttgtgatcttgccagatcgataggcgatatctaaaatctctttgcattctttggataaatgaaggagcttgtttaactgtatgtggcttaaatggctggtatcactgcattgatagttttttaataactttttttctctttggatggttgtttcgatgcgttctttgatctgattggatgtttcttgactctctttttgtatcttctgtgtgtcagcctcttttttacttagacataggaccatgtcaaaacggtctaagatcggaccggacaatttctttagataacgctttttttcatgataagtacatcggcagatcccatcttccaatccataaccgcaaggacatggattcatagtggcgatcagttgaaagtctgccggaaacttgtggtagatcccatttctggtgatatcgatcgttccatcttccaatggctgtctgagtgcctcgatacattctgttttaaattccataaattcgtccagaaataaaatgccatgatgtgctaatgtgatctctcctgccgtcggcgtcttgccgcctccaaggaatgcggctttcgggatcattggatgtggctggcgaaatggtctggtatcatcttctaaataccgtggaattccagtggcatcatagattgcctgaacttccatcttctcttcttttgatagttgtggaagaatggtcgggatccttctggctgccattgtttttcctgaacctggggaaccaatgatcaatagatgatgtcttccagtgaccgcgatctccatcgctctttttaaatgttgttgtccgatgatgtcactgaagtcttcttctgactcttccttttgataagttgttgcacttctgcaacttttttgatgatatgttccatgaaaatagtccaggacatcctgtaaactgtccataaataccacttcaatatcttcaatccctcttagagaattctcatcttcacttgccgcaaagaacttgtgaattccttgttttcttgcttctaaaacgatcggaaggcagtttcctacacctctgatcttgccgtttagtcctaattcccccatgatacagatgtcatctaacttgcttgcatcgattaaattcaggcatcctaaaaaggccacggcgatcgggaaatcaaacgcggttccgttctttcttatattggctggggataaattaacggtgatcttcatcgacggtaagggatggccgatggagcgcagtgctgatgcaacccgctcttttgcttccatagattctttagaaagatagcctaccattgtaaaatatggcaggccgtttctgatctctacttctacgtggatgagctttccgctcactccactgacgattcctgtgattacttcctgataaataatactcaactccttctcttctcaaaaaggaagctggtttcaaaatgatatggttagtttatcacaaaagtaatatttttacaatcttgtttattcaaaacaattgtgattattttaataatttctttaattcactcataaatgtgttcacatctttgaattcacggtaaatggctgcaaatcttacgtatgcaacttcatttaaatcctttaatttgtccatgaccatctctccgatcacagatgtttcaacttctcttgttcccatgttatagatctttgtctcgatctcatcgatcgctgcttcgatctgccccatggatactgggagtttgtgacaggattgtacgattccattccggatcttgtttcgatcgtagagttgtcgtgtcttgtctttcttgatgacactcaacggttctgtctctatcttctcataagttgtaaaacgttttccgcattcgtcacattgtcttcttctacggatcgcattgttgtcttctgccggtctggaatctacgactctggaattctcacttccacaatatgggcatctcatcttcttgtacctccgtgtttttactgcttgaagtatatcattttttttgtagaaaagaaagcttttcttttatttcaggcattctttttcgttgatatcgactagaatcgtatctctgccgatccttacaatgcatttgtaggggattttgtaaactttattcttgccaacgcatatgagcatcttcgttgttttgggaacgatcagataacagatcttacccgtatggatttcaaattcgaggtctaggacaaagcctaaacattctcctgtattacaattgatcacatctttttgccgaagttcgagaaatttcatgtcaggaatcctttttcttcctattataatagtattctttttttccatgaatagaagcagaaaaaagcaggagattctgatctctcgaatctcctgcttctttattattataatgatataaagaaagattaagcttctttctttggtgctggtttcttaggaactaatttctttcctgtaatgattccttttggacatttacctgcacataatccacaacctacacatttatcataatcgatctgtgcgatgttgttttcaactttgatcgctccaagtttacatactttttcgcatgctttacatccgatacatcctgctttacatacagacataacgtttttaccgaattctttagagctgcactgtactcttgttttcttgttttctggtacaaggtcgatcaatgcttttggacatgtttctgcgcattttccacatcctacacatgcttcttcatcgatgtgagcgattccgttcacgatagagatcgcattttctggacatactgctgcacagcttccaaatcccatacatccaaattcgcatccttttggtcctgcacctggtacgttcatcgcttcgatacagctctgaactcctgagtactggtatttgtcagatgctttttcgcaagttccggcacattttacgaatgcgactttcttcacgaattctcctgcttctacacccatgatcgcactgatcttctcagctgcagctgctccaccaactggacagccgttcactggtgcttctccatttgcgattgcttttgcaagtccatcacaacctgcgtatccacaaccaccacagttatttcctggaagttctgcacggatggctacttccttctcgtctacaggaactttaaatttctctgaggcaattcccagtaagattgcgataagcagaccggttcctccgacaacaaccatggcaagtaaaattgctgatatattcatcttctttacctcctaaataagtcctgagaatccgaagaatgcgattgccattaatcctgctgttaacagtgtgataggcattcctttgaaagattctgggatgttgttgtattccatcttttcacggataccagcaaggataacgatagcaattaggaatcctaaagagataccgataccattgactacgctggcgatgaaactatagtcgttctgtacgtttgttaatgctgtaccaagaactgcacagtttgttgtgatcagtggaaggaatactcccagagattcatataatgctggcatagatttctttaataccatttctacgaactgtactaatgctgcgattaccaggataaatacgatcgtatttaagtatgttaaatctgttggtactaataaaaatgtataaattaaatttgtaactgctgatgcgatagtaataacgaagagaacggctgcacccattccggctgctgtctcaactttcttagaaactccaaggaaaggacataaaccaaggaactggcttaatacgacgttatttaccagcgctgaaccgatggcaattaacagtaaacttttcatcttaatcctccttatttgtcatctacagttgtatcaaaaaagcttctggaaccgcaagcgctgtttccgcagtgagcacaatctccgcatccaccgctctgtacttctccggcttttttaggttttttgctcttaactttattctggatcgctactaggcatgcaagtacgaagaatgctccaggtgccaggataaagattgtgattggttcgtatgcagatggcattacctgcattccgaagatctgacctgctcctaataattcacggaatgctcctaaaattgttaaggctacagtaaatccaagtcccattccaagtccgtcaaagaaggagttaatcggtccgttctttgctgcaaaggattctgcacgtccaaggatgatacagtttactacgatcagtgggatgtataatcctaatgcgtcgttaactgctggaacatatccctgtaataggaactgtacgattgttaccagagatgcgataactacgatatatcctggaatacgtacacgatcagggatgacatttcttaatgctgaaatgatcatgttagaaaacattaatacggctgttgttgaaagtcccattcctgcaccgttgatcgcagatgttgttactgctaatgtaggacacatacctaacattaagacgaaggtagggttttcttttacgataccattaatcaatcgttccattggatttggtttcatgtttaattacctcccttcaggctctttgaatatgcaacacagctgttaactgcacttgtgacagcacggcttgtgatcgttgcaccactgatggcatctactttagaatcatcgttcttaccagatccatcttttacaacttcaaatttgtctgcttttttgtttttaaagttactcttgaattctggttctttggctttcatacctaaaccagctgtttcgctgatggataatgtttcataaccattgactgttccatcatctctaacacctacagataaagatacatctccaccgtatccttctgggtttgttacagagaatacgtatccaagttcttttccgtttttgtcaactgcttttacaacttcagaaatcgtgttctgtccaagatcatttttctttaagacagctgctacgtctttctggtctaattttactgtatcgaatttcgctgcatctttgaatacagctttgtaagcttcctgttttgtcttttcttcctgtgcggcgatcggtgcttttgttacattatatacgatacctaaaaggagtcctgcaattaatgtgatcacacataatttgatacaatccattacgagattcttattcattgctcttacctcctttttttacgattccaaatggagttggtactgtcactctctcgatcagtggaactaataagtttgcaatgatgattgagtaagatacaccttctgccattggtccgaacagacggaataatccagttaaaataccaagaacgatcgcatagatgatctttccgttctttgtaattggagatgttacgtagtctgttgccatgaagatcgcacctaacattaatccaccactgaagatctgtgctgccatgtaagatagatcaaatccatgaccaccgaagatcagtacgaagattgctacaactgcaacataaacacatgggatgatcggagagatgactttcttaaatactaagtatgctccaccgatgatcagtaataatgcagatgtttcaccaattgttccaggaacgaatcctaagaatgatttcataacatctacgctttttccctgttccataacagcaagtggtgttgctgttgttacaccatcatatgtaaatgttgtcattcttgctgcaaatgagatcattaagaaacatcttgcaccaagggctgggttcataaagttctgtcccaatccaccgaacacctgttttacaacgatgatcgcgaagattccaccaaggattggcatccagaatggtgctcctgatggtaagtttaatgcaagtaacagtccggtcaatgccgcacttaagtcacctacagtgattggctgtttcataagtttctggtaaatatactcaacgacaacacaggtagcaacagaaattgcaactgtcagtgccgcagatgctccaaagatatagataccaaaaattgtagcgggtagtaatgcgatgataacatctaacataatcttttgtgttgagccgttatctcttacatgagggttggctgacacatgatataatgtttcgctcatatgtatctctcctttatttctttctacggttagctaatacctgtttacgacctgtcttcatggactgtgcaaggttacgttttgctggacatacaaatgaacaagatccacactcaacgcattctgctccataaagtttctcaaactcgtcaaactgattatgatctgctaatacagataattttgctggcatcagcttctgtggacagacgcttacacatcttccacaacgaatacaattgcttggttggttcgcagcaacttcatcttttgtgaatgctaagaagcatgagaatgttttgacagctggtacatctgttgtaaacattgccatacccatcataggtccaccagaaatgatcttctcaggctgtgtcttaaatccaccggctgcttcgatcagttcctgtacgtttgttcctgtacgtactttaaagttgcttggattcttgatcgcatctccagtaactgtcacaacacgttcgtataatggtttaccatctttgacagcttctttgatcgctacgatcgtagctacgttatctacgatacatcctgcatctgctggtaacatgctggagttgatgcttcttcctgttgttgcataaatcaaagaacgttctgcaccctgtgggtattttgtctttaatgtagcaacgctgattcttgcatcaccttttactaatgcttctactttagcaattgcatcttttttattatcttcaataccaatgataccttttgcttttgggaacatatcaagtacgatatttaatccttcaattaaaagttctggtgtctccattaagatgcggtagtcacctgtgatataaggttcacactccgctccatttacgatgatatattcgatcgcatctggatcttttggcgctaatttcacatgtgttgggaatccggctccaccaagtcctacgattccagcttctttgatcgctgctaaaacatcatctttagacatctgatcataaggttttgcctcaaaggcagcctctttgaattctccatcattctcaattacgatagagttaacttttgctccggctggagtcattcttggctcgatcgcctttacagttcctgaaacagagctgaaaatattcgcggatacaaatcctccagcttctgccaccttctggcctactaacacctggtctcccttgctaacgattggctgtgcaggagcaccgatgtgctgacctaaaggtaaaacaacatctccttttggcaggtattcggtgattggtgaattctttgcaaattctttaccatctgccggatgaacaccgccgctaaatgtaaacaatgccattttaagccttcctttcttctttacatttttttccattgcgaaaaaaaagagttctcataaaatgaaaactcctttgaacacaagacttataataccatagtcttttttatttttcaatgtttttttaacaatttctttgcatttgcatacaaaaaatctatgtttttcttcagattttcttaagattctgaaataatttacaattctggcttttatattctatcatttacggatctgtccatttccataaataataaatttgctggttgtcagtgcatctaatcccattggtcctctagcatgaatcttctgggtactgattccgatctctgctccaaatccaaattcaaatccatcagtaaatcttgtggatgcattaacataaacggctgctgcatcgatctgatttaagaattcctgtgcattctggtaagaatctgtgacgatcgcttccgaatgccccgtattgtaatgattgatatgtgccactgcttcgtcaaagctatcgacagttttcacagaaatgatagaatctaagtattctgttccccagtcttcttctgttgcagggatgacctggtcatttaaagcacaaactctctcatctccacgtacctgtactcctttttctaataaagcatcgatgatcgctggaccgtgactctccaagatgttcttatgtaatactaaagattcacatgtattacatgttccaagtctctgtgtctttgcattgatgatgatgttaactgccatgtctttctgggcaaattcatctacgtatacatgacaatttcctgttcctgtctcgatcactggcactgtagaattctttacaacactctgaatgagtcctgcaccacctcttgggatcagaacatctaagtattcatttaactgcatcatcttcgtagctgtctcacggcttgtatctgtcagcagctgaatgctgtattttggcatattgcaggattctagtgcactctggatcacatttgtgatcgcaagatttgaattgattgcatcacttccaccacgaagaaggcatgcatttcctgtcttaaaacatagtgcaaatgcatctgctgttacgtttggtcttgattcgtagatgataccgacaactcctaatggtactgttttcttaccgatcaaaagtccattcggtgttttctgcatatgttctacagaaccaattggatcatgtagttcagctacctgacgaagtccttctgccattgcttcaatacggtcaggattcagggataagcgatcgatcaacgcctcgctcatatcattgctttttgcattctctacatctttataattctcacttaagatatattcctgattctgtaccagacatttggctgcttctcttaatacttcattcttatcttcaatccctgcttttccaagaattatcgatgcttcttttgcctgttttcctagttgttccaacattatgaatgcctccttttcggtgcggtttgcatctatcatcaatatgttctatctaatctgctctagtttaatccttttggttttaatggagtgatcgatccatcttcatttttaatacttacattattaagctgcgctcttaagtttgcacgaacagactggatgtattcatgtcttaattttctctgttcttctttctgttctggtgttaacccaatggatttatccagattgtataattcattaattctttgaatatctttttctttcatctgtaatatttcctttctatataatacattgttttatcttattatgccttaaaatatgggcgttctgttaaatatttcttgaaatcaaagtctggtcgtttgtgtgctaagaataatgttccgatctcttctcctgcaacaactttattgacattatttaaattattgctgtttacgatcaccatatctgctccagcatctgttacgatattggctgctgcgatcttcgtttccattccgccagttccgaccttagttacagctccttttgccattcttccgatcttttcatctaagaccggtacttcaggaatcagtttggccagtggattcttgtgtggatcatccgtataaagtccgtcaatatctgtcaggaggatcaatagatcaccttgtacaaccgcagttacgactgcagataaggtatcattgtcaccaaactcgatctcttctgtcgataccgtatcgttttcatttacgatcgggatcacgccgagttttagtaattcttcaaatgtattcttggcgttatatcttctctcgtcattgagcatcgtctcttttgtgatcagaatctgtgcagatccctgattgtattcagcaaacagtttctggtagatcatcattaactgtccctgtcctacagcagaacatgcctgcttcatcggaagggatgtcggacggttttctaatcccagggctttaaatcctacaccgattgctcctgaagataccaggatcacgtcttttccgctgttatgtaagtctgttaaaacacggactaatttctctaatcggaataaattgatgtttcctgttgctttatggatcaaagaagatgtacctactttgacgatgattctttgtttatcttttagtttttcacgattattcattttacattcactccttgaaaggtattttacactgtaacgagggcttgtgcaaccttaattccatccattgccgcagaagtgatgccgccagcaaaacctgctccctctccgcatgggtagattcctttgatattgctctcaaatccttgatctctctcgattcttaacggagaagatgttcttgcttcaattccgcacaaaatcgtatcttctcgattaaatcctttgatctttttatcaaaatattgcattccttccgaaatcgcttcactgaccggttctggaagacagtttcttaagtttccaaaacttgtcaatcctttggtattcggtgtgatctcgccaaaggattctgtaatctttccttctctgaaatcttttaatgtctgaaccgggattcttccttttccttcgctaaaagctttttcttcccatttctgctgaaatcttacgcctgctaatgcgtcatttccatcaaaatcctctggtgtaacacttgcgatgatcgcactgttggaattctttgctgctcgatcgtgattgctcattccattgaccgtcaatcgttctggctctgaagacgcgttgaccacgaaacctcccggacacatacagaaggaatacacacttcttccattgtttgcatgatatgttagtttgtatgatgcagctggaagatcatattgatctgctccctttccatactgcgaatggtcgatcatctcacgcgggtgttccacacgaagtccgattgcaaaagctttaggattcatttccagatcacgatctgataagactttaaatgtatctctggcactgtgtcccggtgctaagatcgctgtttctgttttaatttcttctttatcattgatgatcagccctgttaattttccatcctggatcacgaaatctgtcactttcgcctcaaaacggacatctccgccaagagatctgatctcttctctgatccctgcaacgacatttcttaaaagatccgttccgatatgtggtttattttcatataagatctcttctggtgcaccatgttctacaaaagtttctaaaacgaatctattccttccgaatttgtcttttactaaggtatttagttttccgtctgaaaatgttcctgctcctccttctccaaattgtacattggattcaggattcagttcaccactctcccagaaatgttctacatctttcatacggtttgtgacatctttccctcgttctaagacgatcggatgtaatccggctcttgcaagcatcagtgctgcaaacagacctgccggtcccattccgatcacaaccggtggatatttaaattcccgctgattttctggaaattcaaacttcttttcttttactgccatgatattacgattcttgttctttttgaggaatttctcttcttgacccttacctaatgtcacatcaactgcatacacataagataattcttcttttttcctcgcatcaatagaccgttttacaatcttgtattgtttatattctgtattatgtaatgctttttttatcttcttctcaagtgctgcctctttgtgatcgatcggcagcttgatctggttgattcttatcattgtcttcctatctggcttgcagcgatgtatccagatgtaaatgcccactgaaggttgtaccctccgcatgttccatcgacatctagtaattcaccgacaacataaagcccttctaataactttgattctaatgttccttgtatgatttcttttgtggatacgcctccggctgttacctgtgccatatcatatcctttatatcctttgatctcaacttcaaagtgttggatcatatctaagatcctgttaagatctttcctggatatctgagcaactggttttcttggatcaatctttaatctcagtaagattgcatataccagttttttatttaaaaatccctggaagaattcttcgactgtcttataattgcagctctttaagaatacttctgttgtttcttctaaggttaccatctgtggcatgagatttaaatagatttttacttttttctttcttcttaatgcttcgatcgcaaaatgactgatctggaaaatcgggatccctgaaaccccatattttgtaaactgaacttctccatgttctttggcgatcaattcattattcgcgtagacgctgacattactgacatttcgaactcccgaggtgtcttttaaatattttccttctgcttctaatcctaccaaagacgggaatgtatccgtgatcttatgatgaaagtctttggcaagcttgtatccacttccgttgcttcctaagtttggctgtgcacatccaccagttgcaaggatcagattgcttgactgaaaacatttgtcatttccatagacataaaatgtggacttacgtttctctgctttcgtgacttcaaattctgtcagaatatccacgtgcagatgctttaatttctgtgccaatgtgtcaacaacagttgctgcctgcaaagatgcaggataataatacccattttgctctgtcacaagcattccgagagattcaaagaactgaatgagatcttctaatccaaattcctcgatcatcggataagcaaaggaaggtctctgccctctgtagcaattctcgtccatgtaggcatttgacaggttgcatcttccatttcccgttgctaatattttctttcctaatttatccatccgttcaagcaagaggactttcttatgatgactagctgctgtgatcgctgccatcataccggaagcccctgctccaacgatgatcacatcatatttcattcgttatttttctccaaatttttattttaactactgtatgattccagaaaatgatatacttcttctctgttttcaaagataaaattctctttcagcatatttttgatgtctgctggcagattctctttcttcatatctgtatattcaaaaacttctttggtcttattgttgatcacagccagacttccatcaagaatcttcagactgtacgtcgccttgactttcttgactgctttggtctgttttttttcagctgttgttgttatctgagaacgaacttccttgaggttgtccttcttttcatttgctgagaatgcaagataacacatacagatgcacaaaactgtgatcacaaccatatatatcatcaaaaatcgattgatcttcttcataatgcaaccctcctttggctatattgttaccaaagataagggaatttatacaaaaagcccaaatcatagcagatctggactttttcttccttttataaatggaagcccttacgatccttacagcaaatgtaatttctttgctaatctgacgatcagatttccttttggaatcttagtaagttcttcttctgtaaatactcttaacttaatgatcgctgcaaaatagatcagtgctccaactggcactgcaatgatcacgcagaccgcaaagcatactcgcccgaatggaagaacgctttgaaccgcatactgaatcagaaaacagacaacacccatcactgctgcacttaatgcaggcttgataaatgtctttgtgatctcctgatgaaaacctgtgtatttcttgatggagtgtgcatttaacagacacatcacaagggaaaatgccatagtcgcaaataccaatccatatgttttacaatctgtgtatgttaataaaagccataatacaacgatattgaccacaacggaaatcgcagaatgtctgactggcactctcatctttcccattccctgtaagataccatttgtcaacgttgacagacagtagaaaataacggaaactgcaccgatccgaagcatagctgctcctaatcccttggcatatgttgcaccgaagatcaatccattgatcgaactatttaacacacctagtccaaccgcacatgggatcgcgatcatcatcgtaaaacgtatcgccatctggatactgtcgttcatatcgtccttcttgcctaacgcataggctgcagaaacatttggcacgatcgcattggaaagtgcagatgccatcgcaactggaacattgatcaacacgttatactgaccgctgaacaaaccataaaattctgaaactactttcgccgtaattccttttcctactaagatattactaaagatcgtctggtcgatcgttgcactacagttatagatcgctgtactaaagataaccggtgtgatcgttaataataagatctttaagatattcccataagattcaatatattttgtacggtcatgtttcatctgaatcttgacctttggctggtatgcacgataaatgatagagcagaagatcaatcctgttaaaacaccgactcctgtaccgatcgcactacctgctgccccatgtcttgcgatctcatatgtgatcttgttagatggcagatatggtaagatcagtacatatgccatcaaaatactaaagatcgcattcaagatctgctcaatgatctgggaaatggatgttggcaccattgtattatgtccttgaaaatatcctctaagtactccaagaatcccagagaaaaagatcgttggggaaatgacctgaagggcaagtgctgcacctttttgatgtccgacaaaggttggtgctccaaaatatgcgatcatggacgcgataccaccaacgacaactgcataaactaatgctccatagaagattctctgagcattgatatattctttcttcgcaagtcttgcagaaattgatttggataccgcaagtggaatactaaaggatgcgatcagcagaataatgttatagatattatacgcataagaatagtaccccataccttctttgccgatgatcccaaacagtggactacgatataataatccgatcacacggcagacaatggatgctgcggctaagatcattccttgcattaaaaatgagtttttgctgcttttactcatactaaacctctttcatctcttgtatatttcgtctttgtcaaaatctcttcctgacgtttttccatatcttttcgttcttcctcttccatatggtcatatccaaacagatgtaacatactgtgagcgatcaaaaaggcatattctctctccctgctgtgtccataattctcggcctgttcccataccttgtccatggagatcacgatatctccaagcagaaattcaccactctccggatcaaatgccatcggatcttcttcaatctttgagaaatccgctggttcttcgtattctgccattggaaaagacagtacgtctgttggtcggtcgatctctctttgttctttgttgatcgcatgaatcgtttcattatcggttagcattaaattcacttcgcactcataagggcagtccacataatcaattgctgcctcgatcacttcatgtgcgatcttttcataagggatattgatctccccttcgtattcattctcgattataatactcataacattcctatcttctgttctttttgttattgttattcttattctttttcgcagatctggctgcttcatattgatcatatgctgcaacgatcttctgtactaatggatgtctgacaacgtccttattggtaagctcacagaccccgatctccttaacttttcttaacactcttagagattcttctaatcctgaaatactgtcaaatggcaagtctttctgtgttaagtcacccgtgatgatcgctttggacccaaatccaatacgtgttaagaacatcttcatctgagcaggtgtcgtattctgtgcctcatctaagataatgtatgcattatccagtgtacgtcctctcatgtaagctaatggagcgacttcaatcaagcctttctccatattcttcataaatgcgtcagccccaaggatctcatataatgcatcatataatggtcttaaatatggatcaactttactctgtagatctccaggcaagaaacctagcttctctcctgcctcaattgctggtcttgttaaaatgatacggctgacttcatcattcttaaatgctgtgatcgccattgccattgcaagatatgtcttaccagttcctgcaggaccgactccaaatgtgatcatcttattcttgatcgcatcgacgtatttttgctgtcctaaagtctttggtttgactgctttaccctggatcgtatgacagatgacatctttatcaagctccaaaagacttggagatttctcttccattgataacgataacgcatagtttacattctgctctgtgatcacatttcctcgtttggataattcgagtagttcatcgatcacggagatcgcatgattaactgcctgctgtgttccaatacattttaaatggtcacctctcaggatcagactcacatgcagtgttttttcgattttcttcatataggcatcaaactgcccgaatacattcccgccatgttctgccggaaaattcatttctatttcaactggattcatctaattctcagtctccttctttgtgtatattccttatgtattctaccatctgttacaaagtttttcaacctgagtggcaaaatccatatggcctgattcataacttttatttattgctgcgctgttgttggtgtgatcatttcttcttgtttctttgttaatttcttgatatttcggatctttccgacactttcttctttgataatcgatgccttaacttcatatcggttgttcttttttttataatttccttcacagtgaacgatctttgctcctgcttttgctttcttcataagatatcgttccaactgtttttttaattttaactgtgcttctttttttgtcaagattttcttctttggcctgtatctttcagttatctgcatcgtgatcccaatgggcagataaaaagatttccctatctttaatgatcttctctttgtcataacatttgtatgatcctgtcttttcttttcgggaaaatcgaattgatactgtccaaaatataaatttttgatactctttttcttgcctgtgatcagcttctcgtaatattccatgggaattgaattgttgtacacctctttagtgcgcatcacgatctctccgtccgctttgatcttatccgtctgtgtcacagtaaaatcatcactgtagtaatagatcaatccagaaattaaagttgttccgcttttgacactgtccccaacacttacaagcggcgttccacttttgaccgccatttttgtaatgatccctgatttatttgccacgatatcacatggtttctttggattctgctttgttttgcgatctaaggtctcttttatctcaatatgcagtcttgttccctgaatcgaacaggatgcccacgcaatctcagcataatcttccctcagatggtcttccaatgcatcacagtcaatctggtattttaatgttccaatatggtagtagttatccgtaacatactttaatatatcactttctgaatatacttctcctccagaaactgtaatctcccataaaaactgactcagcgaaaggatcattaaaccgcacaaacacatggaaaaaaataatattttacgttttttatgttcttttaagaaatatggcagtcctttttgcccttgtaacgcaagatcaacatttgctttctctgctaatgcttccaacatttgataagaacttcgtctgataaaaaacacatagccgtctgatactggttttaattcccacaatacaagatgattttttgcacagagattcaaaaaacgctctgtctgatatcctttgacttgaaaatacagccttccaaatataaagtgcagaattttaagcatttctcatgctcctttcaaagaatatcatacatattccagccttttgatctttcctttgatcttcattgattcctgtgagtaaaaatcaactgccagatcacatccacagatatttaatataacatgattcccctgaatggagatcttattctcatcatatgatacgatccccctgtaattttctatgtatgcttcacagtttcctgtcaaggttataatgaaatctccaaacaccacatctcttggaagagaaagtcctttagcaatcacttcttttggtttcttcttcatgcaaaactccttttgtggcatttggtttaatatatgccgaaaaaaagcatcatatacctgttcccaggtaaatgatgcttatcttttcaatcaagtaaaaattatttagattttctcttacgagccgcttcagactttttcttacgtcttacgcttggcttttcgtaatgttctcttttacgaatctcctgctgaattcctgcttttgcacagtttctcttgaatctgcgaagagcgctatctaaagattcattttctttaacgattacgtttgacattctattcccgacctcccctccagtcttgtacttgtgcataggactgtttgggttttaattttttgcactagattagtatatcacattttagatttttgtcaactatgaaatttgactttctaaaatttcttttacttttgctactgcttctggaattccggctggattctttcctccggcctgagccatatttggacgtcctccaccgccgcctccaacgcatccggcgatcgctttgatcaggtttccagcgtgtgctcctgctttctgtgcctcgtctgttaccatggcaactaagaatacttttccgtctttctgggaagcaaggacaatgacaccttctcctaatttctcttttaagttatctccaagttcacgaagtccattcatatcaacgtcttctatagaagttgcaagaagtttcactccttttacttcttctacctgatccataacatctcccagagcatcttttgcaagtttgctctttaaggattcgttttcgctctttaattcttttacttctgcaagaagtgattcaattcttgtcagcagtgttgctggtgtagcttttaatgctttggctgcttcttttaattcttcttcctgcttatggtagtagttaaatactccctgatctgtcactgcttcgattcttcgaactcctgatgcaacaccagtttcagataaaatcttgaatgctgtgatcgctcctgtattcttcacatgagtaccaccacataattctacagagaaatctcccatggatacaacgcgtacttcgtctccgtatttctctccaaacagtgccatagctcctgttttcttagcttcttccatagacataacttttgtcacaactggaagatcctgagcgatcttttcgttgacgatcttctcaactcttgcgatctcatcatcagataatggtgagaaatgtgtaaagtcgaatcttaaatgttccgcattatttaaagatcctgcctgctctacatgagttccaagcacttctcttaatgctttctgtaataaatgagttgcactatggttctttgcacctaatgctctattcttctcattcactgtaaagactgctttgtctcctacgttgaatgttccttcgactacatgtccaacatgtccaaacttaccaccggataatttaatgacatcttctacttcaaaagatgcatctccgctgatgatcacacctttatctgcttcctgaccaccgcttgtagcatagaatgctgtctgatcagcgacgatcgttcctttgtctcctttgttcagagttgaaacaacttctgtctctgttgtcatagctgtgatctcaccttcacaagtaagttcatcatatccaacgaattttgttgtcatggctggatctaactgttcgtatacagttgcatctgcacccatgtagtttgttgtctttcttgcagctctggcagtctctctctgaacctgcatttccttttcaaagccttctttatctacagtaaatcccttttcttctaagatctcgatcgtcagatctaatgggaatccatatgtgtcatataatttgaacgcatctgcaccagcaagttctttgctacctttctcgttcatagctttttccatatctgctaagatagacagtccctgatcgatcgtcttgttgaactgtttttcttcctgagataaatgattgaagataaattctgctttctcttctaattctggatatccatctttagattcacggatcacgactttactgatatctgttaagaacagatgatcgatccctaataatcttccatgtcttgctgcgcggcggatcagacggcgaagtacatatccacgtccttcgttagatggtgtgataccatcagataacataaatgtagcagaacgaatatggtctgtgatcacacggatcgatacatctgtctcgtggtctgtaccataagtaactcctgcaactttacagatctcatcgcggatagctttgatagaatctacgtcgaagatagaatctacttcctgtacaacgactgcaagacgttccagtcccatacctgtatcaatgttcttattctctaattctgtataatggttgtgtccatcattctcaaactgtgtaaatacgttgttccatacttccatataacggtcgcagtcacatcctaccgtacagtctgggcttccacatccatatttctctccacggtcatagtagatctctgaacatggtccacaaggtcctgccccatgctcccagaagttgtcttcttttccaaaacggaagattctctctggtgcgattccgatctctttctcccagatctcgaatgcttcatcatcatcttcgtatacagatggatataatctgtcaggatctaatccgatcacttctgttaaaaattcccaagaccatgcaatcgcttcatgtttgaagtaatctccaaaagagaagtttcctaacatttcaaagaatgtaccatgtcttgctgtcttaccaacattctcaatatctcctgtacggatacacttctgacatgttgtcactcttgttcttggtggtacttcctgtcctgtgaaataaggtttcagtggtgccataccagcgttgatcagtaataaactgttatcgttctttggcacgagtgaaaaactctttaatgctaaatgtcctttactttcgaaaaactcaagatacatcttcctgagttcgttgactccatatgctctcaacgtttcatcctcctagtgtcgtttcattatatttaagaagaccttgcctttacggctttttagctgcatgagcctgtattctcatgcagctaaatgatcttctcttaatcatgtatgatcttatgattctttcttctttgccttcgcacgaccgactccgaaataaattcctgccgcagagcatgcaaaaagaatcgcaaacttcaatacataagagactaattctgataaaaatgctgtcataatcttgcctccttatcttataaagtcgattataccaaatcgaacttagaaacacaaatattttctcacaaagattacgttcttaatcttctttttctaataaatctgtgtagaagcaagaataatttcctgtatggcaggcagccccaatctgttttaccttagcaagtaaggtgtctctgtcgcagtcaatatataaatctttgacatactgataatgtccggatgtctcccctttgatccataattcatcacggcttcggctgtaataagtcataatccctgtctcgatcgtcttatcatatgcttcttttgtcatatatgcgaccatcaaaacttcatttgtcttatgatcctgtacaacaacggttaacattccatcgctgtttaatttgaattcatcaaaactcatcttgctgtttaatggttttgcctcattactcatcttataaggctcctttcgtggaaagtacatctgtgatccttggatccatgctggttgcttcatccaaagcttttgcaaatgctttaaatgctgcttcgatcatatgatgattattctctccatgtaatttcttcaaatgaagattcatcatgctgccgtaagatactgcataaaagaattctcttaccatctctgtatcaaattctccaacgcgatcaaccgtaaaatcacaatccatcacaaaatatggtcttccagacagatcgatcgcacataacattaatgtctcatccattggaagcataaatgatccataacgtttgatccctttcttatctccaacggcctgtctgatcgcttctccaagtacgattccgacatcttcgatcgtatgatggcagtctacatagagatctccctcaacttccacatcaagatcaaaaaatccgtgacgtgcaaatgcatttaacatatggtcaaaaaaaccgattcctgtatggatatttccatttccatttccatcaagatcaatggaaagtttgatctttgtctcacttgtatttctctcaattgatgcacttctactcatatttttatccttcctggttatcttcaaatcttactttcatggaattagcatgtgctgtcagctgttcctgattcgcaaagaattcgatgtctttgtgtactggctctaaggcttctcttgaatagtagatgacacttgatttcttgatgaaatcatcaacacttaatggagagaagaattttgctgttccatttgttggaagtacgtggtttggtcctgcaaaataatctcctaaaggttcacaactgtatgctccgataaagatcgctcctgcattcttgatccttgtcataacatcaaatggatttgctgtcatgatctccatatgttcagacgcaatagcgtttgccgtatcaattgcttctttcatatcgcttgcaacaagaatatatccgaaggaatctaaagatttctccatgatctcttttcttgataactgatttaagaatccgtcaatctcatcagatactttatgtgctaattcttcgcttgttgtaacaaggatcgcacttgccatctcatcatgttctgcctgggaaagtaagtctgctgccacatatcttggattcgctgtttcatcagctaacactaagatctcacttggtcctgcaatggaatcgatacttacgtttccataaactgctttcttggcaagagccacaaaaatgttaccaggtcctacgatcttgtctacttttggaatagactctgttccaaatgccatcgctgcaattgcctgtgctccaccgactttatatacttttgttgctccagcttctttcgctgcaactaatgtatttgctgtaacttttccgtcttttccaggaggtgttgtcatgatgatatttttcactcctgcaacgtgtgctggaacaatgttcattaaaacagaagatggataaactgcttttccacctggtacatagacaccacaagtttccattggtgttactttctgtccaagcattactccgtcttctcttgtctcaaaccagctcttctgaatctgtttttcatggaaatcacgaatattcttgatcgctttgcggataactttgatcaattcatcgtccacttcttcgtaagcttccttaatttcttcttctgtaactaaaatattctctgcgttgatctccgctttatcaaactgtgctgtataatcaaagacagctttatctccattatctctgacatttttgatgatcgcatcgactttatcctgaaaatccccatagtttgtaggacttctttttaataaatctgataaaatatttgcaatggaatctttgttaacttttactattctcatatttctctcctccggcctattctttttcatccaagatcttctttagtgcaacgatgatcttgctgattcgttcttgttccatcttctggcttacctgattcactaccattcttgctgataatgggcaaacttcttctaagacttccaatccattttcttttaaggttgttcctgtctcaacgatatcgacgatcacctctgataatccaacgatcggtgcaagttcaacagatccgtttaacttaacgatctctactgtctgtaatttctgattattgaaatattctttagcgatatgtgggtatttggatgccacacggatgatctcattactgtttaaatatttcttcgcttctttgggtccgcacacacacatcttgcaagctccaaatttcaagtctaatacttcgtatagatttcttccttcttcaaggatcgtatcttttccaacaacaccgatatcagctgccccatattccacgtaagttggcacgtcacttgctttggataagaaaaattttaattttaattcttcgtttacgaagattaattttcttgttttctcgtctttcatttcctcgcatgtgattccgatctcttctaataaagccatcgctttctttgcaaggcgccctttcgccagggcaaatgtaatatatctcatggtcttttgtttcccttcttttgctcgatttgttgattagatgaaataaagaattccaccgaggcgatgctctttagcaaatctttcatagtctgctttgctgcacagatcattctttctctctaagatgactttctttccttcttttcttaattcttctgctcgaaggatcgcatctttcattgttgcttctttataaatgatcattgtatccatatgatctgcttccatatgaattccctgacggcttaatgccatcatcagctcatctaatacgatcgcaaatccaactgatggggctttctttccgaactgttcgatcagattatcatatcgtccaccttttagaactgcatctcctgttccataagtataacctttgaaaatgattcctgtgtaataattatgcttatttaacattccaagatcaaaacttacatactgctctttgccgtataattttaagatatcatatacatcgcgaagtcttttgatcgctttcttagactgttcattctcaaccattgcttctgcctgatctaagattgctacatctccattcagttcgttaaaatgtaaaaatacatctttaatcttatcagacagatctaatgtctctacatattccattaatccaaaataattcttatttaagatcagctctcgaagctgtgttttgacttcttcatctttgatcgtctgtgtcaatccgttgaagaattcaacttctccgatagaaagtctgaaatcagtcaatccagctgccagaaaacaatcaattgccattgcaatagattctgtatctgcctgtacagacgcatcattgactaattctgcacctaactggcatgtttcttttaacttcaactgatagcttgagttatttaaaaatacatttcctgcataagataaacggattcccatattctcttcattaaaatactttgcgatacagcgtgcaatggatggtgtgacatccggacgaagaactaaggtatttccttctctatcgaagaatttaaacatttcccttgcggatacggttcctttttcactgttaaatacatcaaagaattcaaatcctggagttctgatcccttcatatccgtaagatgcaaaaactttgtttaattttgccttcagcttacttcgctgtccatattctgttccatatacatctctgacaccttctggtgtgtggactctctttttattcatatttttgccgctccttgatactttatcgaattaaagtgctacttaggtagcacatcaaattatctgtattttaccaatccttaacttatttgtcaacctcgttcactctaattcatcttttgatatgttacatgaaattcctacaactgagaaacaacttcttcgatcacctgatccatgatctctaccggatcatatacaaggtccacgctgcaatattcacaaatatcctctaatgctccaaaaatccatggatttcttgctttgatcgtcttcattcttccattctgctgcacaaaactgataaagaatcctaatgttctgctgatctcatcatcaccctcttctaaaatatccattgtgatcacaccgccatcggtattatcatatgccataaataaaagtggattctttggacgctccccttcttcttccccttctaccataactggaagataagtaaaatctaaaatcacttcaagatcgatttgtttttgattctttaattcatcttttaattcctgatcttctaacatcactgacggaaattctttttcagcttctggtatctcttttacaaacatttcccaagtatcattttcagtattataacggcgaacgattccttctgcctgttcgatttctgggtttaattctccctgtctgactgcttccactgccatatacaggttctcataagtttctataagaagtgcaacttcatcttcatctaactgatatggtttgtaacctttcttataagaaacaaagtaaatccagtcactgatcgtcttaaaacgaatatctaattcatcgataacttttctttgttcatctggcacattcatcatgcttccccagaagcatgtaagacttgtgtgttcatccatcagatactgtgctggaagatccccttcttcacttccaaggatcatatagaaatctcctaagccttcaactccatcaaagactgcaattcctctttctccgctgaattttcccatcacactgcaaaatacaggttcttctctgtcttttagctgaatggttacaagttgtgtgtcaccaaggtaattccaaggctctaatttgtctagttttaatgtaatgtcgtataactgcttccatgcattctttgacgcttcttttctcaatgacttgtcctccatagattattttattgtacacttaatattcattataataagaaatgattttaattacaacaaaatcccgactatctttctatgatttgtgaatttgatcgttttttctttatactttttcgaatttctgatataattgtttgacggatttatcttattattttaaattagataactgattttattaccaggaggtatttatcatggcattcgacggatttgtcatttcaaatattatatcagaacttaataaacagatcatcggtggcagaatctataagatttatcagccagaggccgacgagatcacgcttgtgatcaaaaaagagagattgacaacaagacttcatctctcagccagtgcttctcttcctcttgtctatttatcgaaagaaggaaaagcaaaccctatgcaggctccaaacttctgcatgctgcttcgtaaacatatcagcagtggaaggatcatttcaatcacacagcctgactttgagcgtattatcgaaattaagattgagcatctggatgaacttggagatgtctgccagaaacgtctgatcgttgagatcatgggaaaacacagtaatatcatttttgtaaacaatgatgatgtgattttagatagtatcaagcatatctctgcaaatatcagttctgtcagagaggttttacctggacgtacttacacatttccaccgtctaaagggaaacatcctttagcaagtctgactgcagaagatttttatcagcatatcatcacaaaaccactgaatctttgcaaagcactttatacttccatcacaggtatgagtcctttaatcgcaaatgaactttgttatcgtgccggactcgatgggaatgcatctacggattctttgaccgatgatagtgctgctggattatatggtcagcttgtaaaattaaatgctcttgtagaagatgaggcatatcagccaaatatcatttattctggggaagaacctaaggaattttcttgtattcctttaacttcttatcctgactgtacagagaaaacatatgattctatttttgacgtgctgatcgggtattattctgagaaggaaaaatatacaagaatgaagcagaaatcttctgaccttcgtaagatcgtgcagactgctcttgagaggacaagcaagaaatatgatctacagcttcgtcagttaaaggataccgagaagcgtgagaaattcaaagtttatggagaacttacacagacatatggatatggactagagccaaatgcaaaatctttaacttgcatgaattattacacaaacgaagagattacgatccctcttgatccaacaaagactcctttggagaattccaaaaagttttttgcaaaatataataagctaaaacgtacttatgaagctctttctgagcttgtcgtggagacaaaagctgatcttgatcatctcgattcgatttctactgctctttctttatccgaagatgagaaagacctgcagctgatcaaagatgaactttctgattatggttatataaagagccatgggaagaaaaagggaaagaaacaggcaaaatccaaaccattacattttgtctcttctgatggtttccatatgtatgttgggaaaaataactatcagaatgatgaattaagttttaagtttgcaaatggcggggactggtggttccatgcaaagaatatggctgggtcccatgttattgtacgaaaggaacaagcggagactcttccagatgctacctttgaagaagctggccgccttgcagcttattattccaaggggcgtcaggcaccgaaggttgagattgattatgttcagagaaaagaactaagaaagccgccaaaggcaaaacctggatttgtcatttatcatacaaactattctatgatgtgtgttccgaatattgatggaattgaaattgttgaatagacagttgtatttataatgccaaaagaggcgaccgaaatattttcggccgcctcttttcatatgattatatgagttaagaaaaaaggttgttaatttgatttttggttgattttattgatattatttcgactacattgcttcgtagattgctacgacatcatctaaaatcttttcatctgtgattccagatacttcttttaatgctgcttttactccgtttgctttgatcttatcctgtaattctacgctctgtggatcttcagcattatcatattttaatgctgctgccattcctgctaataatgcatccactggaagaccatattctaatgctgtcattgttggttttgttaaacgatctgttgcacttaattttcttaatggttctctacctacacgagctgtatcatctacaaggtatgggtttttgaaacgatttaagatcttgtcgatgtatttaaagtgagcatctttgtcaaatccatatttgttgactaatgccataccactctgctgcattgctttttttacagttttaaagatttcttcatcagcaatactttcatcgattgttttgaatcctttgtagtttccaagatatgctgtgatgcagtgtcctgtgtttaatgtaaataattttctttcaatatatgccattaagttatctgcaagattcattccttcgatctgtggaacagctcccttaaaggatgcttcttcgacattccattcataatagttttctacaacgacgtcgattggattatctaaacgtactggaggcacgattctgtctacagagcagtctgggaatcctacatatttgtctgcatatgctttttcttcgtcatttaagtttccataaacagcttcttttaactgagaacttgctttgactgcattttcgcaagcaatgatgtttaagtattcttcagaaccattttcttttcttgctttgattccttctgcgatagatggagcaatgattggaagaattcttactccaacggctgttgtgatgatctcagcctcttttacttcatcgatcagttcaggttttgttgaatttactccgctgatatctgtgatcacgatctcgctgctttctacgtcttttacaaaaattgtatatttcttatcttcgttgatcttatcaatgattttctgatttacgtctgcgaatactacatgatatcctgctttgcttaacagtccaccgataaatccacgtccaatatttcctgctccaaactgaattgctttcttcatttttctcactcctaaaattaaaatataaatttataagtatatatcttaggtattcaataagcgagaagaatttcccgcttattaaattgacctttttttgtttaaattttatttaaacatttccatgatttcgtcaacgttttttgttgtttttaactgttctaatctttcaggatcttcgatgatttcagagatcttagctaataatccaagatgttcatcaccgattccagcaataccaaagactaactgagctttttctccatcaaagtctacaccttctggatactgaagcattacgataccagttttctgtactttcttcttggcatctcctgttccgtgaggaattgctacacctaatcccatgtatgttgtaactgtttcttcacgttttaccatagcgtcaatataaccttcttcaacatatccaagttcatttaacagttttcctgctgctttgatcgcttcgaatttgtcgactggttttaatcctgttttgattccttcttctacaaggatctttgcatttccagtagctactggtgtttcaacttcttcaacagctgcagctgtctgtgctgatgcatcaacttttgctgtcatctgttcatataatccatctaagtttggatcctgtaagaagttattgataattactaactgtgcctgtggtgcagattttctagctctgtctgctaaaactgcctgaacaactgcgatatcacaatctgctggaatattatctacagatgtattgataactgtaagatctggtctctgtgctttcacacggtttctgaatttcgtagctcccattgcggaagatcccattcctgcgtcacatgcaaatacgatcttcttaactttatctgcgtctttcttctctcctgggtcaactgtgattcctttagattctgctttctttgctgccatatcgtcctgtgcatcttcaagactcttaccatctgacatacgaatgataggtgatgcgatcaagaatgatactacagttgcgatcagtacacctaagatcgttaatggaatctggctctttggtgacattgataaataagcgatgattgatcctggtgaagatggtccaataagtccgcattttgtaaatgtgaagaatgtgatcgcacaaatgttaccaacgatcggagcgatgatcacgattgggttcatcaggatatatgggaagtaaatctcatgaataccaccgaagaaatgaatgatgatcgcacctggtgcagatgattttgttactttgtctttagagaatattgcatatgctaataatactccaagtcctggtcctgggtttgcctctaacatatacatgatagatttaccagcttcttttgcctgttcaataccaattggtgtaaagataccatggttgatcgcgttatttaagaataatactttggcaggttcgataaagattgctgctaaaggtattaattttgcttttacaagtacgttaactcctgctgttaacactgctaatacggttgacataaatggtccaatgataaagtatccaatgatcgctacgatcattcctaaaataccaacagagaagttattgatcaacatctcaaatccggctggcatatgtccgtccattgctttatcaaatttcttgatgacccatcctgcaaatggtcccattaccatggctcccattaacattggctgtccatcaaatccaccaactccggcgatacaacccatgactgcgattgcacccataactcctccacggtctccaccgacctgtttaccacctgtgtaggcgattagcattggtaataagaatgttaacatgtatggctgaattgatgctaacttcgcatttggaatccatccatctgcgataaataatgctgtaatgaatccccatgcaatgaatgctccgatattaggcattaccattgcacttaaaaatttaccgaatttttgtaatccatttttcatttacaatatcctccttttgctttctatcttctcttcattttgttttcgtaatagttgccaaggcttgtttcaagttctgcctcgactgcatttctgtttttgtcaaataagtaggtgatgatctggtctttctcggctaatgctccgcttatttcactcataacttcgcgataaaccttacttccatctccctgtggaacaagcatcaagatcgcacccttgattggctgcccatcttcaatgatctcatcatttaaatagacaaaaccaaatctgcaatgtctgatggcttttgtttcacaatgtaaaaataatgcattcatactcggaataaatgtgcttgcgatattctcgcgtttgtttaatgcaaaagtaatctctgttgctgtcgtttcatttcttgcaaataattctcctgcatattcgatcaattgtttcttattcttaatgttttcacctgttgatattttaatgttatctaatacctgtaagatttcttctccaagaagtgtcatatactcgatgtcttctcttccaatccttttgactggttttacagtctttatgggattttttcttttcttcttgtcgatatttttgatcatggcattgatcattttcttatctgtctctgttaaaatagagttcacatagacatttggaaatgtcagatttaattttgctgtggaaacgataaaatcaattccttcttcgattagctcctcttctttgatctctgctgtcgagatgatcttttgtaccatcagctgcggaaattcttttttcagatgaacggctagcatatgggatgtcccaactccatgtgggcaggcaacataaacagataacttttcttctttatctttttgctgttcaaccgctacacagaagtataatgcgataaaccccatctccccttccgggagtttttttatatgtaattcttcttttaagaactcacacgctttgatcgttgccacatacactttggaatatttttcttctaaaaaatcaatgtattgattttccgtaaatacaccttgtttcattcgattgatcgctggtttcatatgattacataatccatcgatcaacactgcattctcaaaaaattccatttctaaaagtatttccatctcagcaatgatccgcatgaccaactgcctgactttaaaactttcttcatcgatcttattctcacttttgtttttccagatcttcgctgccaaaagctgcattgctatgttatatacttctccttgtgagagctgatgtctttcaaagttgcttaacttgcctcccagccattttgcaatctgatattctggtaaatgagtgatcgatttgacgtctttctcttctttgatctcatgtcccgttcttaccctgttttgtgtgatcaataaatacaagcttaaatgcctaatggaatggtcagtatattctatatctaacactccctgcatatttttaatgatatctcttgtatcatctaacacttcttgcgtaagattcggaaacattcgttctttgagttttttctctttatcaaacaatacttttaaggaatgtcctcttaacttttgtctcaataccattgtcactgcctgacggtaatcttcctcttttccttcccagtaaattcccattcccggtcttcggtaaagagtcagattatagtgatcaagccatgtttcaacctcttccaggtcgttgcttaatgttgcatccgaaatatgaaaaagggatgtaaagtaaaaatatttgagtggttcgttgatcgttaacagttcaagtaatatgatcatctggcgatctgctttactgtatactggcttgttctcatccatatctacgagttctttaatatagtttcttgtttctgcatcttcatccacatacatcccgattcttggtttcttgactagtttgaagtcattctcctcaaaccattcgttgatgcgaggcatttctcttaatacggttcttgaacttaatttcagtttttctgatattgcctgtattgtaattggatcgtcagcattaaaagctgctaacatctcaatgataagtttctgtctttttgttaatccggatttcttagacactctgtatcatcccctttcacgtattattatatatacaatgggtggtttggacaagcgattgatatgatggttttgacgacattcaatagtgacattttgttgtcagtatttatagtttgtcagtattatttcatgacaagttttgattgtaatagtgttgcatgtatgagtcagaaagaagataagaagaactatttataagaaaaaaggatgacactccgcatttttgaaagcgttttttacaaatcgctgatccgcgcctgttccttcgataactcgcttgctgcgagccaaaatgcccgcagctacgttcaaacaatcgaccacagggcgctgcgaatttgtaaaaaacgcattcaaaaagtgctcatgttgtcatccttttttcttataaatagttcttcttatcttctttctgactcatacaacggaacgctattcaaatcactacacagtgtgtatattaaatggtattggctgataagttttggattcgttgacagaaggtcaatgaaatttataaacaccaatttgttgaagtgttttggaatataataaatatctgtctaccattacaaaaattgaaaaccaataacgtctaacatacacacccttctgtttgaaaattcttaattttatacgagaatgtcttcaggtattcataaaaacataaaaaaagatagaggtacgaaatgatagaattccataggattttttgcaaaatcgcagccaacacgggcactgtttgaacgcagtgaattgtgcaggagtgttggcgaatcagcgttttgcaaaaaatccgtcaatggaattcgtttttcgtacctctatcttttttatgtttttatgaatactcgatacatttccgttatacaattacaatttaattagtaaatactatccctaaacacaatcttacgatatgcttcaaatcgtaaccagcggttaaagaattcgcttcctggtttgtatccttgttcttttaattctgcaaataacttatctgctttttctttggaatctacaagtatttcaaatccacgtccgttgattaatggtaatcctttgtattcgtattcttcgattggctggattgctgctaccttgcggtctctgatctgtacggctactttgtctctgaatacgatgacatcaaagtagtctggatactgatagctttctccttctactggaatttcatctccgatcgtgtaagattttccagatggtttgatctttgtgactgtcatactttccatgttgtagtagaattcttcaaagatgtctccattggcttttaattttccatgtgcaaagacgcattttaggtctgtttcttcgtcaacttcggaatttttgatcactccgcatgcagatgtcatgtttgtgatacggtcgatcaatatcagctctcctaaggctttatgatcatcaaattcgtctaagacaatttcttcctgcaagataacatcacatactgcgatctcattctttcttaagttgtttgctggaatgtattctcctgtgttgacatcgatcttgtactgaatatttgttacgattcctggaatttcttttgttccgatctttacgaaatattcttttcctggtaacaattctccgtcatccatccaaagaactgtcgctgtaaatgatttgctgactggaagttctgttttattggccagtacgcatcctctggatacatcaacttcacggtctaactgaatcgttactggacggcctttttcagctgtctgtgcatctttatcaccaattaataaactcttgacctttgcatgttctttgcttggtaatgtcacgatctcatctccgacagaaatctgtccggattcgatctgtccctggaatccacggaatgtgtggtttggacggcatactctctgaactggcatgtagaatccttcttcttcagatttctctcgtacatccaccgtctctaggtattctagtaatggttctcctgtataccatggaatgttatctgattttgttgtaacgttatctccttctgttgcagatactgggatgatctttacatttgcaagtgataattcttcttgtaattctttgatctgttcctcgatctttcggaatgtttcctgatcatattttacaaggtccattttattgactgcaaatacgaagtgtctgattcccattaaggcgcagattcttgcgtggcgtcttgtctgtactaatactccttgggatgcatcgattaagatgactgctaaatctgcaaaggatgctcctacagccatgtttcttgtatattcttcatgtcctggtgtatctgctacgataaaacttcttttttctgttgtaaaataacggtaggcaacatcgatcgtaattccctgttctctttctgccattaatccgtcaagtaataaagaatagtcgatctttccaccacggcttccaactttactgtctaactctaatgcttcttcctggtctgtatataataactttgaatcatataaaatatgtccgatcagtgtagattttccatcatctacactaccgcaagtaataaattttaataatcctatcatcttagaaatacccctctctctttcttctttccatgcttcctgctgcttcattatcaataactctggttgttctttctgaagaaaccgcacttaatgtctcgtcaatgatctcatcaagtgttgaggcttttgattccactcctccagttaatggataacatccaagggttctaaatctcacactcttgtattcgatcttctcacctggtcttaattttaatctgtcatcatcgaccatgatgatatttccatctctctcaatcactgggcgttcttttgcaaaatataatggaacgatatcgattttttcgcgtttgatatatttccagatatctgtctctgtccagttagagattgggaatacacgaatgctttctccttttttgatcttagagttatataatttccacatttctggtctctggttctttggatcccatgcctgattttcatttctaaaagagaagattctttcttttgcacgagatttttcttcatcacgacgtccacctccaaatgcagcggtaaatccatatttatttaacgcctgctttagggcctgtgttttcatgatatctgtgtaagcggctccactatcaaatggattaaccccctgttttacaccatcttcattgatgtattctatcatttctaatccgtatttctttgctgtttcatcacggaatttgatcatttctttgaatttccatgttgtattaacatgtaaaaatggaaatggtggtttctccggatagaatgcttttaatgctaaatgtaacataactgagctgtcttttccgatagaatatagcataactggtttttcacaagaagctgcaacttctcggatgatgtagattgcttccgcctccaactggtcaagatgtgataattcgctcattttgatgtcctccaatctaatatttgtttgaatctttcttgttgatctctatggtttgttcttccccggtatattttttgatcttccagagaatcgtatctttgctttcgttaactgtcatttcacttcccattccaccgatatcggctcctaggaaaaatgcgatggctcctgttttacattcttttaagcaggatgtacatccccagcagtcttttggatatttgatgtatgctttgccagttgcatcggtctttatcaaacttccaggacagacgtctaagcatcgtttgcatccaacacatttatttttgttaattctgatgctcatagtgctcatcctcctttactagttctcgtaagatgactttgatctttccatccactttctttgtattgacgtattttttccaatcatcactcttttgtggatgatcaagattttctgcaaaactgtgccatcttgtctcttttcttgcttttaaatgttcgatcagagtcagacagatcgttaatcgttcttttagttcataataaaacattaattcatggtaatcctgagcacttaactgtccagataatgtgatcagattattgatcttttcttttgcgagatttaggcagttttcattaaactgataatgacttgaaattccgcctgcataagcatccatgactttctgcatcgcttcttccatttgctcgatcgtaaaaatactgtctttgtctgataaaatgttgttgtattctttgactttctcgtctaataactgttcttctttgttatctgttatatcaaacgtctgatcttttaatttctctacgatatccagtgctgcgagctcaccttctaccaaagctcctgtcacatatttctgtgggcatccccctgcgacatctccggctgcgtacagcccatggatcgttgtctctcgatttgtgtttacccagtaaccactggcagtatgtccacccacgatatatggttccgttccctcgatctctacattttgttcacttggatctttgccttgctcgatccattttaaggtctggcttggtgccatatttaaatatgctttcttaaggtctgtatctttttccttctcaattccttcggttcttaggtaacaagggcctcttccttccagattttcctgtgttgttccatagacacgctgagaagttgtgattccgtatttatcttcgtaaatctctcctttagcgtttacctgctttgccccgactccctgtgcgatcgttcccgttggtgcgatcgtatctttacaccttaatgcgataaaacgcatctcaaaggttgtcatctcagctccagcatcaattcccattgcgtatccggcaccagtgttaaatggtggataccacatcttatgtcttgaaaatcctggattatttggcttataaagccctgctgcccctccagttgcacaaagtactttcttggcacggatctcataagctgttccattttccatatggaaaccgaaggctcctttgatcgtgttatcttccacgatataatcggtgatattcaaatgattgatcacatctacgttatctagctgatttactgcatctgcaaggattggcttgatattttctccattgatcttaatatttcgatttcctctggcaacataatcaccattttcatcctttaaaataaccaatcctaactgttccatcttgcttgtcacttcatttaaatgttctgacattgtaagaagcaggtcacctcgtacgatctcgtctgcatcttttctcgcataatcaacataatcctgtggttttctttcctttacgatataagcattgatcgcattaactccagctgctaagcacccgcttcgtttgatattggctttctcggcgatgacgatctttgcatcacttttttccctgatcgtaagtgccgcataacatccagctgttccacctccgatgatcaggacatcggtatgtatgatctgttgttttgtaatttccataatcggtcctttctggtatatttcttaaatatagaagacatcgccttcctgcatttctttattctctaataaataagtttccttttcatcaaatacatataaacggtaaataatgatatcaacttcttctccaacgcttaccggatccttttccaaagatctctcagctgtcactttgattccattgatatttacaactacatccagtcgacttccactaaaaatcacatcttctacaattcctttttctgatgcactcatatatcgttttaattcccctttttttgctaactcaaggaattctggtctgacgatcgctttctgtgcatgttctattttttcaaatccttttaaggattcataattttctacaatggatgatcttccaacaaactgggctacaaatggcgtctttggtgatttataaatctctaatgggcttcccatctgctcaatctttccatgatttgtgatcaagatctcatcagcaacctctacggcttcatcctgatcatgtgtaacgaaaatgcttgtgataccaagctttgataccatttcttttagccagagtcgaagctctgatcttacttttgcatcgatcgctgcaaatggttcatcaagaagtaatacctgtggatttggagccaatgctcttgcaaatgcaactctctgtctctgcccgccagataactggttcggatatctattttcaagtcctgataaccccgttaattccagtaattcaaaaactcgttctttgatctgtttcttcggcatttttgcaatctctagtccaaatgcgatattatcaaagactgtcatatatcggaatagtgcataactttgaaatacaaatccaattcctcgttttgctgccggaatatcattgactctctttccatcaataaagatatctcctgcatttggattttccaatcctgcgatcattcgaagcagggttgtctttccacttccacttggcccaagcaacgctgcaagtttccctttttcaattccaaaacttacattatctgatgcccggaagtttccgtattgtttatagatatttctcatttcgacatacattttatcttccgtcctttccctgttgtttgtcctgtgagcggtaccatgcaatatttcttaagatcagtacaacgaccgcgatcaatactaaaaccgatgatactgcaaaggctgctgtgatcgatgatgttgttcctgacatatataaggcatcgatctccaatggtaaggtaaatgtctcacctcttgttttggaaagtgcattaactgcaccaaattctcctaatgccctggcactacataagatgatcccatagatcaatccccatttcatctgagggagtgtgatctttcgaaagatcgtaaatccactggctcccatcaatgctgctgcctcttcttcgtcttttccctgtgagtttaagatcggtatgatctcccttgacacaaatgggaaggtcacgaaaatggttgctaaaataactcctggaatcgcaaatgcgatccggatattcgttccaaagaaggtgttgatcgctcggatcgctggatacgtccatccaagtcttccaaatgtcatcaagaatgcaaggcctacgataactggtgaaatggaaaatggaatatcgatcaaagttgctaaaacctgttttcctttgaaactgaatttagtcaataaaaatgctgccatgatcccgaaaaatgtattgatcgttaccgcaacaagcgttgccagaatcgttacaaataaagcgcttcttacatactccgttgatatggaacttacataaaatttaaatccctcacttaatgaatttgtaataacggaaaataacggtaagaccaacatgacgatcataaataaaacactgatcgtgatcaggatgatcttcgttcgctgttttcttttttcaaacttctgctgttcattcatgatcttctccttactgtgcattgactcttcttgcctgtcttacctgtatgatattgatcacaaataacatcacaaaggaaatgatcagcatgacaagagcaatagctgttgcacttttatagtcgatatagtttaatttctgcatgatcacataagagatcatctgtgtatgttccttggcactgtttcctgagatatagatcacacttccgtattccccgattccccttgcaaatgccagtccaaatcctgttaataatgcaggtcttaattctggtaaaatgactttaaagaatgttcttgtcggtgttgcacctaacatatacgctgcttcttcatactggtcatccattttctcaagcactggctgaaccgctcttacgatgaatggaatcccaataaacacaagtgcgatcaaaagtccgatccttgtataagaaatcttaatcccaaagtgtgcaaagtatcgtccgatcattccatcttctgcatacatttttgataatgtaataccagcaactgcggttggcagtgcaaaaggaagttcgatcatcccatccattaatcgtttccccggaaattcatattttacaagtacccatgcgatgatcagcccaaacacaacattgatcaatgctgcaataaacgaacttccgatacttgtgataaatgcatttcttactgtttctttcgatattaatgtaaagaattcattcggcgataattttagtgcgtatgcaaatacggatgctaatggaatcagtacgatcaatgataacatcgttactgtaactcccatcgttaatccgaaccctggaatgacccttgcttttttcgctttttttaatgtcctattctcgttatttgtattactcatcttcattcctgcctttttattgatttatataaatcttgtcaaacaacgctccatcttcaaaatatttcttgtaagcctgatcccatcctccaaaatcactgatcttatatagtttcatgttcagattaaatttaccttgatactgttttaagattctttcattcgatggccggtatccttcttcggctgcgagtttctgtgctttgtcactgtagagatattttaaatactctgttgcgatcttctttgttccattgacctttacgttatcatcaacaaggcttacacttggctgtgccaagatactgatgcttggtgtaatgatctcgtatttatctggataattcttaactgtctgaattgcttcattctcccatgcgatcaagacatcaccttttttattttctacaaaggttgttgtagaacctctggctcctgaatccataacagatacattctgatataattttgtcaggaattgttcttcctttttctgatcgtgataagtatcaatcgcataaccataagctgctaagaagttccagcaagcacccccgctgctctttggatctggtgtgatgacttccactccttttttgatcaagtctttccagtctttgatgcttttcttgtttccttttcttacaagaaagacgatcgttgacgtatatggtgcagaatcatttgaaaatctcttctgccaccctttatttataagtcctgtctgttcgatcagcgaaatatcatgttctaaggccagtgttacaacatcaccattgcttccttctactactgatcttgcctgacttccagaaccaccgtgggactggatcacttcgactttctttccatatttgtctttataatatttgataaaatctttgttgtatttctcataaaactctcttgtcggatcataagagacatttgtgatcgtaagattttcttttctcttatttccacatccttccatagaaaccataagaatcatacagaaacttaaaaggatcattttcttacagatattcttttctatagttctttgttgtcttattttcatggtttcttctcctttattttaattccatactatttctgtatgttttgtatgaattggattatataagatttctgtatacatgtcaacaaatatcgttataaaaatttataataactgattcaaagaaatttttattatgttcatctttgctcataaaagcacgaaaaaaagacgttttgacatatgttttcaatacgtcaaaacgtctttctttcatttattatttcatatattttttcagattcttcttttgtttgtcactgatctgataaaaagtctgttttccattcttatcttcgattccaatgacagtacgatctccgagaagtatttttgttaatgtaccacttgtatagaaacgatactcattccatgaggctgtatccagtgtggcatcttttccagataatttcttcgctttctcaataatcttagatactttgatcgctgtatcattaaatttcatcttcttatctgttacaacgatctgggcatctgcaattcttgctgctacgttactgtaattcttctgctctttggcatcgatcaacgcatctccaacggttgaagcaccattatatgcgtaaacattctctggaatctcatcaaacacaatataactgtcaccatatactttgaattcaaacgttgtattatcttcatcaatcaacgcataagaataactttgtttatactgcttctctacatcggttggtgtgattccgatcattcgattacatccagttacaatcttctttacatatttgcagacaggaatattcgttactgcaaaactctgattcttgatcgtattcgttgcaaagtcaactttaatgatcctgctatctttgacacgacttttgtagtctgcaatcttttgatctccagaagttgcatggattgctttgatcttcttatttagtgaatttgtttttttcttttcttcttttaactgaacagacagtttatctctttcatctttaagactctgataatattttgattccacgacagcatcttttgacggcttaaagcatcccgtcatcatcacgctgctcattgcgatcaccgctgctgttagtatatattttgcacctttcatatggtttccctccattacaggtcctatcgtttttgagcgatctctcctgcgttcttatagatgctgtttggtgcgatacatccacgtaccatagataatggataaatattggtatcatgaccaaccactgatcctggattcaagatagttccgcatcctacttctacacgagaacttaagatcgcaccgatcttctttcttccagtctcaatcttttcttctccgtttttgatcacaacatttgtcttgtcagattttacattcgatgtgatagatccagctcccatatgagacttatatcctaaaatagaatctcctacataattgtaatgaggcacctgaacattattaaataaaatatcattcttgatctctgtagaatttcctacaacacatcctgccccgatcaatgcatttcctctgataaatgctcctgggcgcacttctgtatctggaccaatgatcgctggtccattgatcgttgccgtcttggcgatcgttgcacttttcgcgatccatacatcttcttctacctgatcatattcatctgctgatagtgttggtccaacttccagtacaaaatctttgatcaatggaagaatctcccatggatacgttgtctgttcaaataattgagctgcaattgtctgatctaaatcctgaaagaattctttgtttgttaattctaccatctgattttacctctttctgttcttattatctgtttcaatccacagtctgtaattttcatttgaaatccaactcgatcggacagtgatctgatcccatcacatctgttaagatcttcgcatcactgatacgatcttttaaacactctgatacaataaaatagtcaatgcgccaccctgcgttattctttctcgcattgaagcggtaagaccaccaggaatagattcctgtctggtctgggtataaataacggaaggtatcgataaatccattgctaaggattgttctcattttttcacgttcctcatccgtgaaaccagcattttttctatttgtctttgggttcttaagatcgatctcctcgactgcaacattcagatctccacaaaagatcactggctttttctcttctaacttcttcaaataagcaagaaaatcctcttcccacttcattcgataagaaagccttgccagttcactttgtgaattcggtgtatacactgtgataaagtaataatctttaaactccagtgtgatcacacgtccttcctgatcatgttcttctatcccaagaccataaaaaacgctgatcggttcttcttttgtaaaaatgcctgttcctgaatatcccttcttcactgcataattccagtactggtgatatcccggaagattcaggtcaagctggccttcctgcatcttactttcctgaatgcagaaaatatcggcatctgtctcattgaaaaaatccaaaaatcctttcttcacacatgctctgatcccattgacattccatgatatgaatttcatctaatttcctccacgtctcttattataaagaaacataatcactcctgctgcaatgatcacacaatatcctacaaaactcagcatatctggaagctgtccaaaaacgagaagccccataattgctgagaacatgatctgtgtgtaatcatatacagaaatttcccttgctggtgcatacgtatatgccgctgtgactccaaactgtcctcctgcagcagctaatcctgttaataacaaaaagaataactgccttgctgaaatcggatgaaaatccatgatcaaatatggtacacacgccaacatagaaaatgttgagaagaaaagcacgatcattggtcctctttctcctctaagtccaagttttctcacacaggtatatgcaaaacctgcacacattccccctgcaaagccgatcacagctgctggtgtcatcccgcctgcgaaacttggttttacaataaataaactaccgacaaaagctgcgatcacgcatgcgcattgtgtcggtgtgatcttctctttcagtactaaataagaaaatacaataacaaaaaatggcgataacttatttagacatgaagcatctgaaagcaccaggtgatctaccgcataaaagttgcagaaaatacctaaggtcccaaaaagggaccttagaataaaccaatgcaaatttcttttctgaatctgaatcttttccttgctacgaatgatcataataaatgccatgaccgccgcaactaaattgcggaaaaaactcttctcgatcgctggaagatctcctgacagctttaaaaacaatgccataagggcaaaggaaaaagctgacagtatgatgcatataattccacgattcttatctttcataacaagattatactcttgaagaatattctccagttcttgtatcgatctttaacgtatcaccttcgttaacgaataatggtaccattacctgagcacctgtttcaacgatacatggttttgtagcaccctgtgctgtgtttcctttttctcctggttcacattctgtaacaagtaattctacagagattggtggctcaacctggaatgcatttcctgcgtgagaaacgatcgtaacgttttcgttttctttaacgaattttaaagaatctccgataacatctggtcctaatgcgatctgatcaaatgtttcgttatccatgaagtagaataattctccatcattgtacagatactgcatttctttacgttcgatatgagcgttttcaaatttctctgttggacggaatgttttctcaacaactccaccgttcttgatattttttaatttacaacgtacgaacgctgctccctttccaggttttacatgctggaattcgatgatctggtaaatattattctcgaactgaattgttaatccattcttaaaatctcctgctgtaaccatattataattgtcctccttaaattatatctttttttattttatcttaaatctatagttgaatcaactatttatttgctaatttatagatttcgtatatgtcattctcatcacagaccttaaaagaaccgatcgttctggttccttcataggaacatccatgtgccatttgcttcacttcttcgtctgtttttgaaccaatttctttcgcctcacgaaaacttgtcggcatattaagtgatgcaaaatatgtaactgtttttcggattccttcctgtgctgccttcacatcgtcagcttcttctacattccagactcttcttgcatactgcgcaaatctggctggttttgcatcatatacataagttgcccatgctccccagacagcggataaacttgccccatgtgcaatatcaaacttcgcactcagttcatgtcctaactgatgcactgcaaagtctttctcagctccaagtcctgtaattccgttgtgtgaaagacttcctgcccacatgatctcactcatcgcattataatcttgtgaatccttgatcgcaaccgcaccatttctgatcactgtacgaagcagaccttctgcaatctcgtctgtcagttcattattctctgtctgtgtaaaataacgatccaatgtatgcatcataatatccacaatgccgcatcctacctgatactttggtaatgtatatgtaagttcaggattcatgatcgcaaatgccgggcggttgaaatctgtggaaagacctctcttgatcttcgtctcttcattcgtaagtactgctgaatcgcttgtctcacttcctgccgctgcaagtgttaatacaactccaacaggaagagatttcttcactgtccgtttcttagaccagaactcccagatatctgtatccggattcgccgttccatgtgcaacagcctttgaggtatcgatcacacttcctccacctactgccaatacaaagtccgttccaaattcaatggatttcttcactgcttctctcgcaaatgaaagccttggattcggcttcacgcctccaactgtcatatattcaagaccggcttcttctaatgaagcaattacctcatcaagtaatccgcttcttacaacacttcctccaccatagacaacgaatactttggaagctttcaggcttttcgcaagttctcctgcctgcttctgtgtctcttttccaaaaatgattcttgttggtgtatactgggtaaatccatgcattcgctcatcctccatctgcccataaacaggggcaaaacttgtgtgttactgattaatctgcatctcttgttaacttcacaacgatctcttctgcgatctcttccacagtcttataatctgtgttcactacaacatctgctgccgcttcgtactttggacggcgttgttccatcatattagaaataaattcagtattcttattcccacgtaataatggtctgtcatcattgtctttgacacgctctaagatcacttctggagatgctgttaataaaacgacctttccattcttcttcatctcagcaacgttctcatcacgaagcgcaactccaccaccacaggagatgatctggttattcttcttctgaagctcaatcaaaaggtttgtctcacagtttctgaaatatgtctctccatattcttcaaaaatcttattgatagacattccttctttcttcacgatctcttcatccatctctacctgtggagatgcaaggatcttacttagatatgtagaaacagtactcttacctgctcccataaatccgatcaataagatgttatgtgtaaataatgtctttgcctgaattcttctgctgttttctacaatataagtaaatatatcaagaatctcatccttataggtattctcatccacatgtgtgagcagcatcttacgctgtctcttttcctgttctggctgaaggattggcaatccattctctttcttgtagaccatgatctctttgatgatatccattctctcttctaatacagagacaatcttcttatcacacagatctaatctctctctaatctcttctaactgactcatcttcttgttctttccttttctatactaaatgtccccatacttctcagataacgaagtgtggtcttgttcagtatatcatacattcctatattttttcaattcattgcctctataatttaggcaaattcactttgatctgtgataaatgaaataaaatctttcacaaccggtgtcagatatttttctttttttagtacaagatatatatatctttcgatctctggtgatatgatcggacgaacacacacatccattgtatcaagaagcggaatctttggaacgatcgcaattccaaatcctgctgcaacaagccctgcaacagaagaatcttcttccccttcatatgcaatcgttggttgccttttaatccttgaaaaacaactgtcgatcactggccttaatccactgttctttgtaaaatatacgtaatcatattcaattgtatccagaagatcgatttcttccttttgagccaatggatggtcctttggtgtgatcaaaaccagttcttcctgaccaaccggaataaattcaagttcatcttccccttccacataagaagaaaatgcaagatcatatttcccatcttttaattcttccacgattttcttcgtcgttccctgtccaaatgaaaaatgaatatgattcttccctttttcttccagataacctttgatcagatttggaataaaatgacttcccaaagtaaagatataccccatatcaataaatccaccgctggttcctgatgtttctgttaccaccctttttccttcatccaacatatccagcgactgctccacataacgtaaaaacaatgctccgtatttcgttaattttgcatttctcccctgtttttcgaataatttcactcctaattcactctcaagacatgagatcgcatgacttaaacttggctgcgtaatggacagcatatctgcagttctagtatagtgttcttccttagctaatgcccgaaaatagtacaaatgattcaaattcataatctattccctttcaattcataaaatttatttatggatagtataccatattcttcattgcatttatatatctactttgctataattatttttagaaaactattaagcaaattggaggatcataattatggcagcaaagaatttccgtaaattatttgaaccgtacacagtaaaatctatgacattaaggaacagaattgtcatgactcccattggaacaaattttgctgagcataccggagaagtaaatgagagaatcattgattattataaacagcgtgcaaagggcggaacaggtctgatcacaattgaagctgcgagtgtttattcaccacagggagcaagcggatcataccagcttcgtatcgaccacgataactatattcctggattatacagattatgtgaaagcatccatgactgcggatccaaaatcagcatcttattaaatcatgctggttctgcagcgaatggtaagataacaaacatccaaccagtatctgcatctgatattccatccagagttggtggtgatattcctcgtgctttaacaacagatgaaatctacacgatcgttgataaatttgctgaagcagcaaaacgtgcagttacagcaggatttgatgctgttgagattcaggctggacatggttatttattaaaccagttcttatctccaacaacaaatgaccgtactgatgaatttggtggatccaaagagaatcgtgcacgtttcactacattagtattaaaagctgttcgtgagacagttggtgaaaatattcctatcttcttaggaatcagtgctgatgaacttgctgaaggtggtaacacattagatgatacattagagatcgttgaatatttcaaagattacgttgatgtatttgatgtttctgctggacttacatgttctatccagtaccagtatgatgcagattaccttccagatggatggaaatcttatatgtctaaatcaatcaaagaaaagactggaaagccttgtcagacaagtggtaatatccgtgaaccagaagttgcaaaccgtattcttgaagatggtgaagcagatctgatcgcaatcggacgtggattgatcgctgatcctgaatgggtaaataaagttcagtttggtaacacagatgatatcaatcgttgtatctcatgtaacaatggatgtacagcaacattaggggatgaacctatcagatgcagcatcaatcctgctcttgtttcaggttcattatataaagataagaaattaaagaaaccatgtaacgttgtcgttgttggtggtggtactgctggtcttgaagctgcatgcacagctgctgaagttggatgtgcaactgttctgatcgagaaatcaggagaactcggtggacttgccagacgtgtaggaaagatgcctaacaaacagcgtcttggatatttccctcagtacttagaacgtcgtgcaatgaaacttaagaacctgtttatctgtaagaatacagaagcttctatcgaatttatcgaaggtttcaagccagatatcgttgttaacgcaacaggatccgttcctcttcttccaaatattcctggattaaaggagaacttagaagcaggtaatgtatctacgatctttgatctggtagatcacgtagattcttatccagaagatttatctggtaagaaagttgttgtgatcggtggtggtaatgtaggacttgacgttgttgaattctttgttcctagaaaagctgatgtaacgatcgttgagcagaaagctcacttcggtgagaaccttgactttatcactaagactggttctatcgaattcatgaataagaataaagtaaatcagtatccaaatgcttctttattagaagttaaagatcacagctttattgtaagacatgactataaagatcttgaattagacttcgattatggatttgtatgtcttggaatgcagtctgcaactccttctcttcaggaattatacaaccacttcatctatgaaggtgttgaagtacttaatatcggtgacagtgctcagacacgtcgtatcatcgaaggtgtaaaagaaggtcgtgacattttagttgcattagaacgtcaggatttcatctaagatcataattttgatttcaaacctttctttaaaagataagaaatatattgtaaaataataaaaaacatggaccagataacaaagatctgacccatgttttttattatttcattaatgttttttcttacggtactgccacaacacaatcttttcaaaataacgctttatgacgatctgaatctcttctttcggattcatcggtgttacaagaatactatgtatacctgttctgttcgctccataaacatctgtaaacaactgatctccaacgaagaatgtattcttcttatccgttcccatcaatttcattgctgtctcatatcctttgatcgatggtttatttgctttgtatacataatatttcccaccgactgcctcgcagaacgctttcactcttggttctttgttgttacttgtaaaacaatactgcatccccatcgcatccagtctcttaaataacttctttgcacgttcatctgctggtgcattgtgtggtactaacgtattatcgacatcaaagatcactcctcgatatccttctttgtagtatcgttcgaaatcaatatcataagtacttctgatatcttcggacgggtagaatttctgaaacataatttatcttcctttttacatctttacattgttcaatcttgtttattttataacagctttttacaattagcaagaagaaaacaaaatatgagaccagttttttcaaaaattctagtctcatatcattcattttatttctctacaccacttaaatatgcattataaatatcttttgagatactcttcttaatcgcatcataaactggctgtgcctgcttacgcatctctttctgtgtctttgtatcaagtttcacaatctttgtaccactgtcttcaatgatcttgatacggtctgcaattcgcttatcagatgcttctctcgcatacactttcgctgtctgtgatgcctgatcgatgatcttctgctggtcttttgacagattattatagaattcatcactgacgatcagcgaaatataatgtggcaaatggtttgtctctacaacataatcctgctgttcatataatttgctggaaacgataacttcgtaaggattctcctgtgcatcgatcgttccctgctgaagtccgatataaacttcgctgaacgtcattggtgttggattcgctccaagtgtcttccagaacttcaaatgatagctgttctccatcgtacggatcttctgccctttgaagtcgttaatactcttaacattcttattggtagacataacacggaatccctgatcggcatatccaagtaatttgtatccacccttctgatatactttctccatcttctgatagaactcttcattatcaacagctgctcgtgcctgttggatcgttgtaaatgcacttggcaggtcaaatactgcggtatctggaaggaatgttacctgtggtgcagtattctgtacgacaaatgggatatccccatctttacaactctcaagaagctcacggtctcctccgagtgtactgtttggataaacttcgatcttcatctttccatgacttaatctggaaacttcttttgcaaacttctctgcataaagctgcgttaccgtatcttccggactggaagttccaagcggccatgcatatctttgtacttcgtctttcttttgtttcttcttgcatccagataaactgaataataagactcctgcaagaagaactacgacggatctttttatgatttttctcatgaaatcctaaacctccttataaaagtgccaggctgatctgtggaataaatgtgatcagaagtaatgcaacaaggaagcagacgatcaacggcattgctttctgtgcgatcttcatcactggaatatccgttaaggatgatgccacaaataagttgactccaattggtggtgtaacgaaaccaattgcaaggtttacaaccatcataacaccaaaatgaatcggattcataccgattgctgtaacgatcggtaataaaattggtgtcaaaataagaatcgctggtgtcgtatccatgaccatacctacgatcaacaagaatatattgatcacaagcaagatcacaatcttattatggaagttacctaagatccatgcactaatggactgtggtacacgcatcaatgttaatactcttgagaatgcaatggatgctgctaagataaacagaattggggcataagttttcacaccttctaccatgattccccagatatctttaaatttcatggatttataaataaataagctgacgatcaaagaataaaatacggaaataaccgctgcttctgttggagatgcaactcctgtgtaaatacatccaagaatgatcaccggacttaagattgcaaaaaagctttctttaaatactccaataaatccttttgcatgtaactgatcaatctctgctgcgatcttttccttatcttctccatgttttttacaataataaatggcatacaccatcaataaggcaccaatcaataatcctggtacaactcctgccataaacagatcacttacagattccccagatgccataccatacatgataaatgggatacttggcggtatgataactccaagcccacccgcaactgctacgattgctgttgaaaatgacttgtcatatcctaaacgaactaagatcggaattgtcatacttcctactgctgctacagttgcaggtgcagatcctgagattgctccataaaataaacaggttacaattactgcacatggcattcctgccgttaattttcctataaaaaacgcaaaaacgtcaaaaatcttcttagagattcccccttttgccatgatcattccagataatacaaacattggaactgcaagtaatgggaaactatcaattcctccaagcatagaacgaatgacaaatgtcccgcttgctgtaaatgatggatcaaatgctcctggaagtacagatacgatcccaagggcgatcgaaatcggaattgcaatgatcagacaaataaagaagagtaaaaatacgactgctgctgacatttatttttcctccttttcttcatctttgcggatcacaatcttaaattcaatgatccaacgttggacgatacgaaatgctactaaaacaaaactaaatagcggggctgcctgaatataatacattggaatctgacatgcgggacttacctgtccactttcaaatgcactctttaaataaagaactgcatatggaatcagatataaaaacaaggcaagttcgatcgtgtggttcaccactttgaacaatgctttccctcttcttggaaacattgctacaaactgttcgattttaatggaaatacatttcttagtacaataactaacactgataaagcctgaccagataaataaatatcttgtcagttcctctgaccatgaaagggacgctccaagtgcatatcttgcaaatacctgaattcccatgatcactgtcatggcgatcaataatgctaccattagaaattcttccagattctcatcaagccattttagcatgattcacctctttctactttctataacaaaagtctttattttcacaaactatggcaaaactttaacaatttgctctactaaattatactgaaaaaataggatttcagcaaatattttttatgtatttaaaaaagaggaaaagaataaccaagaatcttctcctcttctacatttaatttttaaagattcagttcttataatccctgattttcatgaaggaactgaagcatattatttaagtcattgactgctgcctgtccaggtgcagatgcttttttcgctgctccgaatgtaagagcagatccgaatacttcaccgcaaagacggctgatcagccctgttcctgccatagacattgtgatgatcggacgatctgcatgttctgtatacatttcttctgttgcacagagaagtgttaatacgtcacgtctgcaagttggcataactgcgatcttagggatatcagcaccaagttcctgcattttgcaaagtcttcttacgatttcatctttttcaggtgttttgtcaaaatcatggttcgatgcaacaacttttactccacattcatgagcagctgctacgattgcttttacgatctcatcacctgtgaatgcttctacatctacaagatcaacatatcctgtttttgcagcagcgatgtttaattctttgtaaggttctgcttcgattgctttttctccaccttcttttgatgtacggaatgtgaaaagaattggtgtttcacctaaagcttctcttaagtcttttaatacgtcttctactttatcaaattcgaatactccttcgaaccagtcaacacgccattccacaacgtctacagggatgctgtcaaatgttttcgcttctgcgatgatttcatcttttgtaacacctacgataggtacacagattttaggaactccgcttccgatttcaatatttcttacttttactgtattcattgacaatttcctcctattgtccgaacgttctcccgaagcataaacctcgggagttcctattaccaatactaattaatttttagatgcctcttctgcattctttaataatacaccataacgtacgtttacgaaaagtgctaataagattccgattgctgtaattacgatattcatcatgattacgcttgtagatgtcatttttgcagctgctgttaagattgtgtagttacataagctagatgcgatcataactaaacttgtgattgttcctttgattttagggaacagatcatttacaacggctgttgccatctgaagtactccgcctgctgctgcatatccgatcacgaatgctccaacatagcagatcataggtgtcttaataatgtaaactaatgctaacattacaagagagattgctggataaatcactaggaatcttacctgtttgaattttgtgatcaatacacttgttacgaataatgctaccattgtacctgcagaatagtatgtctgcatcacagatacgttctgagatgggatttttgcaatttcagtaccaaatgtctgagcacagtttaaccataactggaatgtagctgtacttgtgaatccgatcaggatcaatgcaatactctcgatagaaaaatgtgcattctttaagttgctgatgaaagattcagattttcctgcttcagatgttgctgggaatggagcaaagattgctaagattcccatgataccgatgcatacaccagcgataactggaagcattaagtatgacatgcttgttcctgctacaatacctaagaagaaaggcattaataactgtgcaacagaaatgaagaatttgatccccattgttgcgatacctgtatatttgtaaataatttcagttacagctggatatgttgctgtatctaagaatgagttcgcgataccaccaagaactgctgcgatataagcaattgttgtgtttggtgagaatgcgatccctactaagaaaataacgtatgaagcacatccaatgatcactgataaacgacgtcctaatttgtcagataaaggtcctgcaaatggaagggagatcaaacgtcccaatcctaatgctgctgcaatggaagttactgccataacatcttttaatccccactggcttgcgagcatttcttttactacctgctgacttaagatggaacatccaattccatgaatgaaatagttcagataaagaactaaggcacttggtatgtattttttatccattttaataattcctctcgtttgctatatggttatgactgatcttagtcatatttgatatctaatacttctttcatatggtcgatcggcatatgttttcctgtccataagtggaaagcagcatcaccctggaataacatcattccaagaccgttcattgtcttacatccagctttcttagcaagtcttaatgtttctgtctctcttggagcgtaaactgtatctgttacgatcaggtctggacggaagtatgtttcatcaggaacaactgtctgtccttctaatggtttcattcctacaccagttgcctgtgcgaataagtagctgtctgcaatttcttctcttaatttatctttgtcatcaagatcgtaaagatttacgatacaatctgtgttttcacggatcttctttactgtttcttcagcgttagcccagaatttatctttgatattgaagattgacatttctttgacaccgtctaatgcagcctgaatctcgattgctgtcgcagctccaccagcaccagcgattgtcatttttttaccgatcacgtcaatatcgttgtcttttaatgactgcatgtatccgataccgtctgtgatatgtccgatcagttttccgttgtcatttacgatcgtgttaacagctcctgccattttagctgctggagataactcgtctaagtactgtcctacaactgttttgttcggcattgatacgttagatccaaccatctttaaagcacgaagtcccttgactgcatcctctaatgtgctgttgtcaacttcgaatgctaagtatgcatagtcaagtcctaatgttgcgaatgcttcattatgcattgcaggtgagcttgaatgtctgattggataagccattaatccgattaattcagtatgtcctgtaattctctctgccataattttactccttaaataatatgcttgttataagtttcatttacccaaaagttaattttttaacaaccttatggttatattatatgctatcttaattgatacttccaatatatcttttagtgttttttgatagcttcaggctatcaatcgtgttataatgaaaataactattaactgctataataaggaaggtgtttaactgttaaaataggcttataaaaaattataaatatatgttggattttataatttttattggtagaataaattataaatattatatggaggatttgtttatgagtaaatattattctatcaataaattttcaaaaatattaggtatatcggttcaaacattaaggaattgggataaaaaggggaaacttcatccacatcacacttccagtaatggatatagatattattcgcatgagcaattaaatcaagttatgaatgtaaaacctaatttagatagaaaagaacttatgaaatgaatatctcaaaataaagtggacaaggtggttgttttttataaagacagattgttacgatttggatttgaattcaaacgtgccaataaagcaagaaaacttgtaaaagaactgatagatgatggtggtgaagaagatgataaaaacaattcgagtcatgctgatcccaaataataaacagaatacaaaactttttcgatatgccaatactgccagattcgcttataactgggcgttaggaagagaaaaagaaaactataaaaatggtggtaagttcctatcggatagtaatctgagaaaagaatttacacaattaaagaaaacagaggaatattcctggttaaatgaagtttcaaataatgtaacaaaacaagcgatcaaagatgcttgtcatgcatataagagatttttcaaaggatgttcaaagtttccgaaattcaaaagccgaaaattttctataccatctttttatcaggataatgtaaagatccaattttcagatacgcatgtaaaaattgagggttttgctgcttccaaaaagaagaataagcaaaagataaactggatcagacttgcggaaaagaatcggatacctacggattgtaactatagtaatccccgtattaaatatgatgggatcaactggtggatcacagtaggcattgaatacgaagactctgttaccgttccctccaatgatgggatagggatcgatctagggatcaaagatctagcgatatgttctgacggtaataaatataagaacatcaataaaacgaaaaaagttaagaaactagagaaacaaaaacgcagattacagcgtagcatctctcgttcatacgagaacaataaacaaggaaaggaatactgtaaaacgaagaatgtgatcaaaaaggaaaaacttttattaatattaaatcatagactaaccaatatccgtcatgatcatttacatcatataacatcagagatcgtaaaacgagaaccaagttttatctgtatcgaagatctaaatgtaaagggaatgatgaaaaacagacatttatccaaagcagttcaacaacagggattttatgaatttaggcggcagatggaatataaatctgagtggaacaatattcaggtgatcattgcagatcgattttttccaagttctaaattatgcagctgttgtggaaagatcaaaaaagatctgaagttatcagaacgtatttacaaatgtgaatgtggaaatgtaattgacagagatcttcaggcagctttgaatcttaaaaaatatggagaggatgttctgaaacgatctgtagcataatatgttcaagtgattacagatatgtactgatacgttagtcaggaattaacgcctatggagagtacaggaacttgtgagtagtacatgaattgattcgttacaaaagcatactcgttgaagtaggaatgaaacataaaggtttataactttttataagttttcagtaacggtatgtatgaatttaaatcaactatactattttcaaaaggtcgcacaattacaacattatcaccaggcagccaaagaattaaatatctctcaacctagtttaagccgttcgattgctaatcttgaagaagaattaggtgtttctttatttcagaaaaacggacgcaatatcgaacttaccaaatacggctctatctttttggaacatgtcaatcgtattatagatgaaatcaaaattgctgaaaataaaatgaaatccttagctggcagttccagcgggcacattgatatcggatatgtatttccacttgccaaaagttatattccaagacttgtacgaagtttcttaaatcagcaggaaaatcatgagatcacgttttctctaagtcaggagatcacaaaaaatctaattgcggatctgaaaaatgaaaaatatgatgtcgtttttggttctctcgttgccgatgaaccggaagttgagtttgttccggttgttaatcaggaaatggtgatcattaccccaccagagcatcctttaaaatataagaagaaactcgttttagaggatctgctggattatccagtcattggttatgataagacttctggtcttggacgttttactaattctatttacaaacaaaaccatatcaaaccgtctatcgcttttgaatcttcggatgaaaatgccatcgcttcccttgttgcagaagattttgggattggttttgttgcacatgtagaatcattacaggcatatgatgtggaaatcctacatcttagtaatgtaaaaccttaccacactgtttatatggcttatcttaaaaatatgccgatgatccctgctgttcgtaaatttattgaattcacaaaagaaacaatagatattttttattgattcttcaaaaaagatttatttgttaaataattaaccgtgtgttatactaaagccatcataaatcattcacccaatttttatgattctaacaacctcggattatatggaatttaattttttgattttttggatttaattttttggaggttcaattctaatgaaaagcaactataaaaacattttcacaccattaacaattaagaacatgacaatgagaaaccgcatcatgatgacaccaatgggaactaactacggtgaacagacaggagaaatgagtttcttacacattgattactatacagaaagagcaaaaggtggagttggtctgatcatggttgaaaacgcaagtgttgattcaccacttggatctaacggaacaactcagatccgtatcgatcatgacaactatatgcctcgtttcttcaaattatgtgaaacattacacgctcacggagcttgcgttggtgttcagttaaaccacgctggtgcttctgctcagtctaagagaacaaacatgcagccagtatctgcatctgatattccttctaaagcaggtggagagattcctcgtcctctgaaagtagaagaaatttatgaaatcgttaaaaaatatggagaagctgctgctcgtgcacaggcttgtggatttgactgcgttgagatccatgcaggacattcttacttattaagtcagtttatgtctcctacaacaaacaaacgtacagatgaattcggtggatgtccagaaaaccgtgcccgcttcacaaaattagttgttgaagaagttcgtaaacaggttggacctatgttccctatcttcgttcgtatcagtgctgatgaactgatggaaggtggaaacacattagaagatactttagagttactttcttacttccaggaagaagttgatgcatttgacgtatctgctggattaaatggttctcttcagttccagatcgatgccaactacttaaaagatggttggagatcttacatggcaaaagctgtcagagaaaaatacaacaaaccttgtgtaactatgggtaacatccgtgatcctcgtgtcgctgacgatatcttagagcgtggagatgctgatatcatcggtatgggtcgtggactgattgctgatcctcactgggtgaaaaaagttgctacaggacatgaagatgacatcagaaaatgtatttcttgtaacatcggatgtgctggaaaccgtatcggagttaaccgtccaatccgttgtacagtaaaccctactgtaaactctggatttgattataaaaagaaaaaagtaaataaaccttgtaacgttgttgttatcggtggtggtactgctggtcttgaagctgcttgtacagctgctgaagttggatgtactacattcttattcgaaaagaatgatcaccttggtggattagctgttgaaatctctaagattccagataagaaacgtttaagagacttccctgactaccttgtacaccgtgcttctaaattaacaaacctgtttatcttcaaaggacaggaagcaactctgccattaattaaagcactgcatccaaacatcatcgtaaactcaacaggttctaatcctttacttccaccaatcaaaggattacatgaccacatcgacaaagaaggatctaaagtagcttctatcacaggaatgatcaaccacttagctgattatccagaagactgcacaggtaagaaagtcgttgtcgttggtggtggagctgtaggtcttgacgttgttgaatacttcgctccaaaaggtgcgcaggtaagcatcgtagaaatgatgcctcagatcggtaaagacttagatccagtatctaaatgcggaacaaacacattaatgagagaacacaatgtaaaccagatgactgaaacagctctttgcgaagtaaaagctgatgcattcacagtaaaagctaatggagaagaaaaagatcttcctttcgattatggattcgtatgcttaggaatgagagcaaacgctcctgttcttgatgaaatccgtgaagcattcgctgatactaacgttgaaatcatcaatatcggtgacagcgtacgtgctagaagaatcattgatggtgttcaggaaggacataacatcttaaatgtacttgcagatcatgaatatctgtaagatataacctagcaaaatatataataaataaagcaattttaattttaacttgctatcttctaccttaaaaataaatataaagttgcaaaaatccctgaagaattgatcgtcttcagggatttttgttgtttttgatactctcatcattatattatgatttttttaggaaaattgacatttatgttttagtttttatgtttcacaagaaaaatctagcctactgtactgctttaaaagcttcctctaaatcttcgatgatatcatcgatattttctgtaccaattgacagacgaattgtgttaggtttgattcctgatcctaataattcctcttcagtcatctgagaatgtgttgtagatgctggatggatgactaaggatttcacgtctgctacgtttgcaagcagtgagaataactctaagtgatcgataaagtcttttgctttctgtgcatcacctttgatctcgaatgtgaagatagatccaccaccgttagggaagtattttttgtataattcctgctgctcaggatcatcagatactgatggatggtttactttttctactgctggatggtttttcaggtattctacaacttttaatgcattctgtacatgacgctctactcttaaggataatgtttctaatccctgtaagaagatgaatgcatggactggagataatgttgctcctgtgtcacgaagtaataatgctctgatctttgtgacaaatgcagctgctccaacgtcttttgtgaagcttactccatggtagcttgggtttggttctactaatgatgggaattttcctgatgcttcccagtcgaatttaccaccgtcaatgatcacaccaccgattgttgttccgtgaccaccgatgaattttgttgctgaatgtactacgatgtctgctccgtattcgattggtcttacaaggtatggtgttgcaaatgtattatctacgatcagtggaatgttgtgttcatgagcgatcgctgctgctttctcaatgtctacaacatctgagtttggatttcctaatgtttcgatgaataataattttgtgttatcttgaattgctgctcttacttcatcttcattgaaaatgtctacgaatgttgtttcgattccgtaatctggtaatgtatgctctaagaagttgtatgttccaccgtaaatgtttttcgctgcaactacgtgatctcctgcttttgtaatattttcaatcgcatatgtgatcgctgctgctccagatgctactgctaatgctgcaactccaccttctagtgctgcgattctctgttcaaaaacatcttctgttgggtttgttaatcttccgtagatgttacctgcatctgcaagtccgaaacgagctgctgcatgatcgcaatttctgaatacataagatgatgtctgataaataggtactgctcttgcatctgtcactggatctggctgttcctgtcctacgtgtaactgtaatgtttcaaacttataatttctttctttactcataatttctatctcctttgttgacttttattttgaattttgtatgttgtctttcttgattacaaacttatcttaccattagatttcctacttgtccaatatgaaaagtcaacatctagttataggatatccctataaccagagtcgtcacccatagctttatactttttgatctcctctaagtatttctctcctaatgggctgatcgcgactccttttcgcttgatatagccaatcgtcatgagctcatccgattttagtttcacagcacagtaatcatcaccatttaagctttcacagataattcctgaacataatgtatatccatttaacccaaccatcagattcagcatggtcgcgcggtcatttgctttgatcagacgtttatattcataggtacttaacacttcttctgcaaaataaaaggagttatattccccctgttcaaatgacaggcatggatattcttccaactcttcgatcgtaatctcttctttatctgccagaggatggcctttccacatataaacgtaaattccacattccaataatggatggaattcaagccctgattcctgcagcatcttgcttaataccttcttattaaattcatttaaataaaggatcccgatctcactatgaaaatctttgacatctttgatcacttcgtatgtctttgtctctctgactgcaaattcgtattcatccataccaaattgtttgaccatctccacaaaagcattcactgcaaatgtataatgctgcatggaaactccgaatttcttcttgatatttttcttctcaatatatcgagattccataagctgatactgttcaacgacctgtcttgcataacttaagaattccatcccttcttgtgtgactgatactcctcgattgcttctcttaaagagtcttgttccaatctctttttctaactctttgactgcaagagatagacttggctgtgagataaacaggctttttgccgcctcattcatagatcctgtatctgcgatcgctataatatatcttaattgtgttaatgtcatggttcttcccttccttatcttttctgtccgtggtttattatacttgatttttcgccgcttgtcttataatttttgaaagaaatgctcttgacatattggtttgctttgtcttataatgatggctgtttcaatagttagaattctaactatcagctttctaatcataaaaggagtatcatctatgtatgaatcatcttatcattatcttctgatgtccaatcatttaagccttcagaagaaaatcatggctgtcttaaagccacttggcctctcaaccggccagccaaaggtcttagaccatcttcgatatcataatggtgccagtcaaaaagacattgcccatgcttgtcatatcgaacctgcttctttgacttctattttaaatcgaatggaaaaacagcatatgatcgagcgtaagaatttgaacggaaatcgccgatcctttcatattttcctgacagattatggaatggaactgtctgaatcgattgaaaaagctttcttatctcttgaacaagaagttttttctgggatttctaatgcagaaaaagaacaatttctaaagatctttgaaaaactatataaaaatactacaaaagaggagtaaatcacatcatggaaaaactaaaacgttatatcatcttttttattgggctttatattaactctctcggagttgccctgatcacaaaagcaagtcttggtacatcaccgatttcttccattccttatgtactgagccttaatttcccatttacacttggaaatttcaccattttcttcagcctgttactgatctttttacagctgttgatcttacgaaagaattttaaactggaacacgtgttacagattccaatctctatcttattcggatattttattgactggtctatgattcttcttggatttgtaaatccgtccttttatttgatgaagatcatttatctgctgatcggatgtctgatccttggatttggtgtgtatacagaagtccttgccaatgttgccatgcttcctggggaatcttttgtacgtgccattgtaatgacttgtcatacagaattcggtgtaactaaaatctgttttgacgtatctatgactgtgattgctggagttctttcctttgtattcgcaggtaagttagacggtgtacgtgaaggtacagttattgccgctttacttgttggatttattgcacgtttatttggacgtttcttatcttttgtggaaccaatgctgttcccagattcagatactaacacagatttagacactgacacagattcaacagacactcctattgtcattacaatcgctcgtgaatatggaagcggtggacatgaccttggagaagctcttgcaaaacgtcttggatttgatttctatgacaatgagattattcagatggctgcaggttctactggttatgatcctgaattcatcaagaataatgatgaacagatgcgaagttccctgctttatgaccttgtgaatcaggtatattctcacgcaccacagaacccagctccaaaagataatatctttgctgcagaatctaaggtgatcaatgatcttgcttcaaaagggaactgcgttgtaatcggtcgttgtgccgatcatatcttaagaaaccgccctcattgcatgcgaatcttcttacatgcacctgcagagtatcgtgtgaaacgaattatgagaacggaaaacttatctcatgatacggcactgacgaaagcaatccagatgaaccgcaagcgttctgataactatcattattatacgcatcaaccatggggattatccagaaactaccatctaacactggacacttcacttggagatgattttgtacttgatagcatttgtgaagggttgaaacatattcagtaatttattatgattgtaaaaaggatagatgccttattaactttggtatctatccttttctactttctaatatttttggaaactgaaatataaaactcgttccttctccttttttgctttccacatgtattttcccgccatgaactgccacgataaagtgaaccatcgaaagaccaagtccagttcctccattctctctggaacggcttttatctacccggtaaaaacgatcccagatcttaggaatatcttcctgagcgatccctatcccatcatcctttacttctcctatgattatatctccttgttctttccatagaatatcaatatgaccatattcctttccatagctgatcgcattctgaacaagattcatcatcattcgcaataataatgtatgatttcccatcatctttacatctcgatcactggaaacagatatctgaatcttctttttttctgcctgctcgcgcaattcttctacgataacttctgttaatagtatgagatcaacttcttccatatcataagattcactcatctcacctcttgcgatcattaacatctcattgatcaatttcgacatgcgtcttgcctgtcttaaaatgatcatgatctcttctttttcctcttcctctaatactggatcttcgatcaaatattcgcattgagaaatgatcacggtcactggagttcgaagttcatgggacacatctgctgtaaactgctgttctttttcaaaggattcttccagtctttcgaacatttgattaaatttatgagataattcatacaattcatctcttacttttggcaatggaagcctttttgtaagatcctttccataactgatattctctacctgatcacagatcagatccacctgctttaatgcacgtttcagcataaaatatcctgtcattgctatcaatacgatgaacactggatataagatgatcatcattttctgagatgttgtcataaatacttcgatcgcatgaatggatgtgatccccctgatccatatagccttattctttccataggtatgcacactgtcatataccatccatttgctgctgccagatgtaatgactctcggtgtatgagactttaagatcgtctgtttcggaaatttctctggcattgtgccgtataatagttttccattatcgtcatagacacaaaacatgactccatcctgataaaactgagtatcttctgatagatagtaagtttcatcctgaaattgaaagtttgcagaaaaacctgtcactgctgtactgacttcttcttctgtcgctgaaatcccgactttatcgacaaagtaaaacataaagacaagaaccattcctaaaataagtgcaataatccctgtataccataatgtgacctttttcttgatcgtcatctgcttcatcattcttccctcatcacatagcctgttccgcgtaccgtatggatcagttttttctcatatcctgcatcaattttctttcggagatatcttatatatacatcaataacattcgaccctccctcataatcataattccatgcattttgttcaatctgctgcctcgtcatcacgatattctgattccgcatcagacattctaacaccataaattcttttgacgacaaactgatctcttttccagctcttgtcacaattcttgtatcccggtccaaagtaagatctgcaatctttaactgattcgttacaaattggggttttctccgcatcatcacgcggattcttgcgagtaactcttcaaacgcgaatggcttgatcagataatcatcggcccctaggtcaagcccctttacccggtcctcaataccatcccttgcagtcagtaagagaattggtgtatcatttcccatctgcctgacttcctttaaaaccgcaaaaccatccttcccaggaagcatgatgtcgagaagaactccatcatacgatgtcatctccatataatctagcgcttcttctccgtctccacaggcatccacactataatgctctcttaccaaacgtttctttataatatttcttaaatctttttcatcttcaacaactaatattctcataatgcctttattataatacaatctgttttttgaatccagcacctatttttaatgttattttaatgtttattggttatgctatttataacaaaaggaaatctatcccaaccaaagaaaggagtttacaatgaaaaaaatattatatttattcttcacatgttctatcatttttgcttttgcaggatgcagtccttcaaagaaagattctgccgaggctaccacaacacaggaaattgcaacaacaacttccactacagaaaataccactgattcttctacctctgattcagatgccaagaatgattcttatgatttttcagcttataaaaaaagaatcaaaaaactcactaaaaaagtaaataatgctgcttcttcttccaatgcatctgtcaacgaaaaacgtttttacactttgaaaaaggaacttgatgtggttgatgatgaacttgatcatctggatgatgaatttgagcatgcttatgaaagcagtaaactaagcttcaaagtttataaatccagagaaacgacaatagaaaaattagaagatcagcttgatcttttagaagatgccttggaaaataaatttggaattgatgattaggtaaaaaaagatgccattgtagttttggcatcttttttttccatctcagtaaaatttattcccaatcattttttacttcttctaatttgcttcttaacgtcttttcaagcccaacaaatgctggaatgaaactatcacggatcaataatatcatctcatcaacttcttgctcattatatatatgaacagatgtatttcttttttttaacatcaatagccataccgctgcatcatctacaaaaccaagtttatatcctaactgtaaaatctctcttggtgacccagttgccgctccgtctgctccgtgcatttttaatatctcttgtaatgccttccatgcaagctcaaatgtcaaattaaattgtccgattacgcctgttctgtaaatatcattattatctgccatttcaaaatctgcactttttaacacttcaagacaattcgaaaagttctcaagctttttcatatattatcacaccatccttttctatttcttgttttaattcctctgaaattggcttatctgcttctaccacatcaaaacttaaaagagaatgtactttttctttaatatcccaataaaaagagtcaaaatctccgccatatacagcaatatcaatatcacttctctctgtattgtcacctcttgctctcgatccaaataaaattactttattgattgaatatttttttgcaaatgcagaaatgtcctttaaaactctttctggaatattgtatttcatatcctgctgcctcctgattttctacattaaatggaatcttatgtcttggaaatattataacatcttttatatctccagtaaatcttccaatttatatcctaataatgcaagccacttacatctcttttttcttaatgatcaaaaaaaagatgccattgtagttttggcatctttctttttccatgtatctctttgttattattgttttcttacgttaaaatgtatgcagattattccactttaatccatctctgtcttttgcccatttaatgtatgtcttctttgctttctttggcacatagactttattaaagattggaagagctgtgaattcatttcctttaaatttgctcacgatcactggtggttttgttccgtggaaatatacggtagcactgtctccaaagaacatccaatcttctacgactttcttcacagattttggaatatgtacctgattcttcgtgccaatcttgcccatcacagaaactgtatcatcaatcacttttactttggatggaattgtgatcttctttgtcttaacaagcactgctgttaatgttccattggatttacgatagatgcagttatttgccatcttgtaagtcttatttttactgcttaagcttacttttgtaatcttcttgctttctaatgctttggcaccaatcttctttactgactttggaattacaatacttgttgcctgcgatccatttagggcatttgctttgatttcttttacagatgatgggattgtaagctttttcatcttgtttggtacaagtactaaggtttttccagatcttgttgtcaacattccttttttcactgcaaatgttttatttgcttttggacaactgaatgtttttacctgattgctctttacaaacgctgtgctgtctatttcgttcatattttttgaaaatgttactttagataatgcactgcattttgcgaaagtatatgctggtacacttgctgtctgttctggaatcacgacactttttagttttttcataccactaaatgttgctatctccaactgatttactgtacctggaattgctactgtttcaatggtctgtttgttcttatcatcatttgacagatctccataacagttatgccatggttcaatggtatctccaaacagattttgataagcatcctcatcctcacctttattatataattcttttccaaatcctactctggtaagttttgcctgattaatctcttttggcaatgttaattttgtgacctttttgcttaatttaatctgatagatccagctttctttgccgtcttctgtcaaatatgcagaatacttgataccgttttcttctttcgtgactgatttacttgtgttccatttggttgctgctttcacattgttcgtgagtgtgattgcactgatcgttgctgttagcagagtgataaaacatagtaatctttttttcatttgattgtccctccttgtttataaaatatatttattgttttcttatattatacaattatttaatataattatgtactaatatttatcatcccataatgtttaataacattttcatctgtaatttttacttgtgtcgcatattttgaaatattagctattctatagtatttatttgcactatcatccacatagtagcttccatcagtatctcctgctgcatgaaaatcatggcaaaccgcaacatcactgcgttttccttggtatctatataaattatttcgttctattctatatgccattgtaaatctgcgcttctgaacattagaatcttatagtaacaaccatccccaaatggtataattaagttgtcaaaatcaactcaccgaaaggagctgattgttatctaccgtcaaaaaattttgaaagacattcattttgctcatctctaataatttaaatacttattttcattatatctttaatcagttatttgtcaataattattttaatttgaaattctttttatttttaaatatttttattataaatatttaaaataatattatactttaattgaaagacaaaataaaatatataatatctttttctaatatcttaccaatactgtcttaaaagggtagatgccaaaacgacatctaccctttttactttatatctctaacaaatcttccgatttacatcctaataatgcaagccaattacatctttttttccatgtatctctttgctattattgttttcttacgtttgttaaaatgtatgcagatcatgccatgtcaaaccatctctgtcttttgcccatttgatataggtattctttgctttctttggcacatagactttattaaagattggcagtgctgtaaattcattgccattatattcactaacgatcactggcggtttcattccgtgaaagtacaccgttgcgtctccataaaacatccagcgttccactaccttatttacggattttggaatatgtacctgattcttcgtgccaatctttcccatcacagaaactgtatcatcaatcacttttactttggatggaatgctaaccttctttgtttttgcaattactccaactaataacccatcggacttccgatagatgcagttatttgccatcttgtaaatcttatttttgctgcttaagcttacttttgtaacctttttgctagataatgcttttgcttcaatcttctttacagactttggaattacaatgcttgttgcctgtgaaccattaaatgtctttgctttaattgttttcacacttgtagggattgtgacttttttcatcttgtttggtacaagcactaatgtttttcctgattttgtcatcaacattccttttttcactgcaaatgttttattggcttttggacaactgaatattttcacttgattactgtgtaaaaatgcactgcttgcaattgactgcatgttctttgaaaatgtaaccttactaagtaccgtacattttgcaaatgcataagatggtacctttgtaatctgctctggcatcttaagttccctaagctttgtcattccggtaaatgaagctgcttctatctgattcacggtattgggaaatacaatttcttgaatcgttcttttattcttgtcattatatgacaatgttccgtagcatccatgccatggttcgatcgtatctccaaaaatatttatatatgaatcatgtccttccccatataattcttctccaaatcctactctggtaagttttgcctgattaatctcttttggcaatgttaattttgtgatctttttgcttaatttaatctgatagatccagctttctttaccatcttctgtcaaatatgcagaatacttgataccgttttcttcttttgtgactgatttgtttgtgttccatttggttgctgctttcacattgtttgtgaatgtgattgcactgatcgttactgtcagtaacatggtaaagcataataatctttttttcatttgcattaccctcctttttcctattgcacatcttcttttcatactaccctgcccctggtcatcacttatttcataaaatcttctgattctattgctattatatcatggtataattatatctatcaactaataaaatcactattttccatatgaaataattaatatcaacataaccacatttttcaacaaatttttctacaactttccaaaagagatacatgattgttccaagaaatgttgctaatattatccatgcaaaactctgtattactatcctatttaaaatcaaaaccatctaaaatgcctttcaattcttctgtatcatctttcttaatatttccactgatcgcacttatcaattctttcgctgaaccatcaaaccattcttctaatatttctcctgctttttcctttttataactttctttgtcgatgattacattaatatatgctcttctttttcttacttctactttgagatatcctttttcttctaaacgaaagagatatgttcggataccaatgtcattaagttaagatgctataataggaatcgctatatcagaaatgatatggggttccttttttgcacctttttacaaaaaatgcttgccaccgattcaaaaatgtgcggccgctttcgctattgaatgaaaataagattgcgaaagcggcccttgtaattaagtaagaaattaattgaaaggaggtaacaaatgaattcacaacaaattaaagaaattttattatctgaaattcacgaggtgtctatcaactatgaaaaatactgcaataatcccaaacgtgatttttctagaaaacgcaaactaccatttgaactaatgctgaaaacatcataggaatgggaagcaaaagtattacaaatgaattgattgacatctttctttttccatgtacctttgttattattggctatttacatctgatcgtgtattctccattcatcttcgcacctgattttgcagttttgacgtaataggtacctttctttacacgatatgtcttggattgctctcctttgaatgaaagttttttcagcactttttttcttccttttttgtaaatgcttacttctaatttaccagaattattatttgtactgatttttatgctctgcttctttgttgcttttactttataccagcgggctgctttctctgatgttgtataaatattccgtactgtttttccttttttaattgtttgtgcttttgctttctttgtctgatatttgttgctgactggctgattctgaagtgcaatctgataaatctgacctgttgcagcattggatactaaacgatattctcctttttttagtcctgtatcaaaggttacccttttatgatcatttgcaaccgctatcatcctatttgtaattgttttccatacacctttttcctttttttgaaggtagaatgtaacatttttattactgtaattagatggtttgagataaatgctttggctgcttctcttatccgttttgaattcttgataaatatttttatcctgccctgactgtgtatataatatatttgtctgaagtggtgtcacattatctttttttacacaaattgttgctacaaattcatcttttatctgatctgccagttttagataatatacttctcccttctttacatttggtacaaatacttgttgatcttctgtatcaagaattgtcgctactgcctttttatccttatcatatacagatacatttgcaccaatttctaaaataccatctgcctgtggataaactggaatccatttactttgtgattttgttgaaaatttgaacaaatcacttgctgatgcatccattttcatgatgctgacatgttcttgtgccttaacttcttctgcatcctgataggttgctgcagatacattcactaagcctccgaatgaactaatcaaaagactcgttgcaagtgcatagctgtaaaatcttttttgtttcataatgaccaacctccttattggtttagttatagttaattgttgcaaaatgtgcaatcacattagcatctgataaatgtacctgtgttccatatttggaaattcgttttactttgaacgcaggatttgatggataatatttatctggatcatttgctgcatggaaatcatgacatactgcaacatcagatctttttccctgataacgatataatgtatttctctctgcacgatatgccatatcaaatctttctggtacaaacttagaattgtctgcctcatttttcttatactgaccttttttttcgttaattgcatgcgttatactgtaccatgttccattgtaataacgataggttgaatgtgcaaaagtatctgttgaagtatgcattgccactccaaatacaaacgcttttttatttgcattgctataatttttgaaaaagctcttcttttgtagattcgccatcattgaacggattcttgaataacttgtatctgttaatccgggaatatctgctttcgatacagatgtatatgtttttccttttccgtattcgtttcctattttgatcataaaacgatagcttgcaagataatttacttcctcatttcctgaatgtcttctctcatataacccatgaaaatctggattttctgtcattcctggaacacctgaatcatctttatctggatacactgctccatctttcattgctggtatatttacattattctctgttaaatattcctgatgtccttttgctgaccatgttccagaaactttattctcatcagaggaattattataagttttaattgtttttgtattatcctttagttcaatatcctgtccctgctcatattgttcttctgcttttgtgtattgcttctctgcatattcatagtcgatcagtccatttccataggattctttgtctcctacatttcttgcactttcttctaacagatttttgataaaatcttttgatttacttgtatctttctgccacagaagacttgctgcaccaacaacatgaggaactgccatacttgttccagatgtaaccattgtttcaccaaatgcacctgttgctcttactgcttctcctggtgctactacatcaacttcttttcctgtagaactgaaatcgcttacttctgctttagaatctacggaaccgactgctacaacattttcaaatgctgctggatattcaacattatctgttccattctctccttgattttctgctgctgcgattactaagattccttttgcattggcttcatcaattgcctgttttaaggcttctgaatattgatttgttccaaaactgatgctgataatatttactttcttatcaatggcccaataaattccttctacaactctgctgattggtgcctgtttattttcatccagaatccttgctgaatataattcaacatttttattgattccttttacttttccattattactgacaattaagcttgcaatggatgttccatgattggaactgtcttcaaacattggagaaaattcattatcatcttctattaaattgactctttcttttacatttaatccttcttgataatcaattcctgaatccaataatgctacttttaccttttcatctgttgccgtatcctttgctttatctacatgaatacttttcagattccattgactgtctgttccctgatcttcttttgctgctgttgtactttctgtttccgatgcattgaccattgtgttcttttctacagatacaactttctgatctttgtttacgatatcagcttcttttgctgtcatttttgatactaatacattctcatcttttagaaaatctgtattttgttcttgagtatctatcattgtattgtatttgctttctactgttttcatagattttttatcttttgttacaatgatatattcgctttcctgacttgccgaaacatctgctggctgatatccagacattgtcatccctgccaccatcattgctactaatgctgtggctgtgtattttctaaactttctcatgtgtttcctcctatactgtagtaaaatcttgattttctgatgtattttgctataatataagaatccatgtgatacgtgtatctgtatattatacagattgttgaagattcccgtcttttgtattacatggattttttaattgttcatatgacatcacctccttctacttattttatacattacttaatatagctccccttagcattaatcgttgaatttgtcatattttgtacaaaaacactatatgtatctgtgtcttttactggtatttctttttccaaccctgtagtaacttcataatacttcttaacttttccacctttgattactccaattcgaacttttttatgtggaaaaatttttaaattaatatagattatactacctgctttttttgtaaaacctttcgatcttttaagtatttgaggtttcacagtccaatccacatttacttttgttgaaaaatttaaaaattcttcttcttcagtttcttctagaaatccatcttccaacacctggtttgaagttatcatttcctgatcttctgatgcatttacatttacaaaaacccccattaaactcaccattatacatatgctaattattactttcttcaaatttcttatcctcctctttcgttatatatggattaactgaacaataacctgaaatatccacatccttttctccataattttcaataaaaattacgtaatctccacttttgtttattttaaaaccatgccataaatttcttccttcttcaatatatctttcctttccatttggttcaataattcctattgctattttcttactaacatgatcctcttctaaccctgtgctaactgaaatttcgatttctttccctttctttttatctatatatttctttttcgtttcaattctttcttttgccttaagttttaaatcaagaattcccgcatcattaacatctggaattatagctccttgttttatcacttctattccttctcttttttgactccgtattttctcttttctgtctattttataatctataactttctctgtttctattactgattcctcatccattgtctgatctgcaacataaacatatccttttgcaaatccaatcgtagatgcagccacagttatcgaacttatgccaaatatgatcaacatcaaactaactgctgttatcctttttaatggctttttatttaaataagactgcattcttttcattcgaagaaccaaaagttcactattttcgcatagccccatacaatatatattgcattccttttcttccgttgctatatctatgatcacgttaaaataagtcttcatgctttctatataatagctagctgttctatcacaatatgcttctccccattggtctaactgtcttatcaaatctttcattcctggatgaaaccaataagtaatatggaccatcataaagattgctttccataacagatcatgatgtttatgatgaatcaattcatggtgcaaaataatatctatttcttcttcaccatattcaatttcaggcaaaacgattcttcgatgaaaaatcccatatgccattggaatttttatttctttgtgttttacaatatcgatattatttttttgtcctaattcacaacaaatctgctgttttttcttgatgatctcaggctgacattttcttcctttctgtaacattttatgcatctgatgcatctttttcatatatatgaaagcccttatcacacttccaataaaccacacgattcctaatactgttaacagaattctaattttattcgcataccaaaaatcaaaaccatacaatcctttcttctttattccaaaaagtactataatccccactggacacagaaatgctaatagtacgatcttccatatccaataattaatctccacatatcccttgctttctgcaagtcttccaagtaacttccaaataatatatatgatcgttcctaatataaaattaagcagtactgctgaaaacagcatcagcatatttttatataaaatccatatcatctaatacaccttttagcctttctttttcgctttttggaatcttttcacttaatgcagtaaataattcttttgctgatccatcaaaccaattgtccagtatatcttctgctttttcttttcgatattctttttccgaaataatcggataaacataggcatttcttccccttttatctactttcaaatattctttatcttctaaacgaaatagataagttcgtatacttgttctcttgtattccttgccataccgttcttttaactcttttccaatttgtaaaaatggaatctcttctccgtaatcccaaatacatttcatgatcatttcttctaaatttgttaatttttccatattctccacctctttaaataacttttttagttatttttatattaacatattttaatcatccattcaacttattttttagtcgttcgtataactttattgatttgctaattatatcaataaaaaagatagatgccaaaatgacatctaccctttttactttatatctctaacaagtcttccgatttacatcctaaaactttcccaatcttcaatacatcaatcgctcttgtgtgattaatatttcgttttttttgctcaaataattgaatctgtctcagtgcaacaccggacaaatctgcaagttctctttgtgacaatcctgcaattttacgtaaacgttttaaatttgtttctgtataatattgatcccatttttcattgattgcttctacgaatttcataatatccatttcatgatatacggaatacatttttagaagatcttctatcgttactactttgtatatcttcataaacggtcttgctgtataccattgatagtacgccaatgcccagccaacccaatattctggtgatttgtccaaatacatttcatctggaatttcttccattataagtcctgctgatcttattacttcttttactatttcacagccattttttcctgctatatatgttggatttccttcttgaaattgtctggatacatcggatactaaaaacattttataaaactcgtctgggtcaaattcatattcatttactgcatagtctaacatatctcctagaattctttgtgctgttagcaaatagtcctcagaataagcgtgcatctccatttttatttcctcttatttttattatatcgcaagtgcgatacttcctcaacaaaaattaatattttcactcctacaatcccaaaaactgcaataaaatctccatcttcaatcgatccacatgatcctcccaatcaatctttaccagatcattcactttatcaattctctttcttatcgtattaatatgcacatacatcttctccgcggtcacgctgtagttcatattattttccagataaatctttaatgtctttaacaactcaatattcttctcttcttccatcatctcccgatatttccttaacatttcttttaactcattctcaggaatctcaatccatgttaatggtcctaacatttcgtattcccagatatccttttcagggaagataatgcttcccatctttaatactttctggcatttcttgacacattctctgacttctaacagtgtcttttcttcctgacagattccaaattccagtctcatatcggcaaattttaatccgatgtatctctggaattcttttaataattccgttgttgtgtctttggtccagggtatgctgttgtggatcttttctgcttctaataagatcaagccatcattttcatccagaaaggcaatctttccgatcttccctaacttgctttgctggaaggcttccaaaaatgtgtttctttcatttcgtgcgttgtatccttcattgcattggtgaaatacaatgtattgataagctgtatttacggaaatcccttggatatttgcctgataaaagagtttcttggcatctttttctgtgtaatcgagggctaaatgaatgaagttctcaaatccgatatttcccatattctctgcgatcatgatctgttcatagactccttgcaatgttaaaaacgcgatacgaatggcaaattcatcgtagtaatcgataaattctctggattccatcacgacaaaatatgcctgcacgatatcttccatgacgattggaataatgatccaactgacacgtggtccttctaaattgccaggattgatcaggcggatccttgccatattgatgtaatcgcataaggtatgtttcgtatagggcattgatggttcccaataatcgctttcggataatccaaaggattctgtgattcgtttaaaatccggggaactgtagtagcttttttcttcagcaagatcatagataaatgccggaaatttcatctcgacttctacggctcttagaatcttattgatcttctggactttgtaggattgatccgatacttgcagatgattattgctgtggactttgaatcttcggatcgttcggttcatcactgcggtattgatctgactcatcaattccatccatggaacagaaaatggcatactgatcagtggaatctcgtattggtcaaacaaatctattaatcgctgtggtatctcgtcaagatagcggcctcgtttgatcatcatggcagaggttccctgcatgcttcctgacttaaatgcttcttcgaggcagtctggttcctgagctaatacatatcctgaggaaaggaccagctcttttccttttgcccagcgcagggcatcgggtgcttcaaggagggttgttccctgaatctctttgtgtaagcctgatttccctgcgatcacgtgatagtctttaaagtattctagtgtcagtagttccttgacagcgattcccattctttatttcctccatttttatcgtgttttttctataaatcattcatcttctatcaaacatccatatatataaaaaagtgtcttcgacacttcaactcccctgcccctcattcttgaggggtgggtttctttttttgtctttttccttcataatagaatcatgaatatcctacaagagatctttacagatcattatgaagaaatcaaatatactcttcatcccagacctgctgagatggaaaatatcgataagatgatcaactgtggtgatccttcttatggtggtgccatgtatggctgtatccactgcggaaatctcaagtttgttcctttccgttgtcacagccgtttctgccctacctgcggtaataaatattccatggatcgcactacctctatgtcctttaagctcgttaatgtcagacaccgtcattgcgtttttaccattgatgcgtccctccgtgattttttcctgcaggatcgctctctccttaactgtctctttcattccgtctccagtgttgtccttcgcttattctctaaaatgaacaaacacaaaaactttacccctggttttatcatggtcctgcatactttcggcagggatcttaaatggaatcctcatatccattgtctcatctctgaaggcggttacagtgatgatgctttctggcgtaatgtctctcatttcaactatactttccttcgcaatgctttccgtactgctctcctcaaggaaatgttgctccgcatcggtccttcttttaaaaaagtttctgcccgttgttatctggaacatgaacacggcttctatgtttatgccaaacccaaccgttgtgaccctaagactgttaccaaatatattggccggtatcttggtcgccctgtcattgccacttccagggtcgattcttataccggtgatcttgtctctttccattacaatcgtcacgaagatgatcaatacgttcaagaaaccattcctgtcatggattttatcaaacgccttatccggcacatccctgaaaaacatttcaagatgatccgttatggcggcctttatgccagacatcgttccattgataaaaaactccatctcgctatttcgaaagaaaaacggcatactttccgttgttttaaccggtggcgtactgcgatcctttcttcttttggctatgatcctctgatctgtcctcattgtaaacaacagatggtgatcctagaaatatatcataaccatcgccgcgtacctcttgaagaattatacgagaaagcaatgtcccgctcccgtggaaagcgttcttctgcatgaccacttctttttatgctataatcctcatataaaggaggaaccctaccatgaaaaagaatatcaaagagctacgcgaaaaatatatttcaaatcccccaaaaggtatgacatccgaggacattcgccatatgagcgaggatgacctgctggatatggattattttctaaatgaagatgtgtttagtgatgattttggtgaagaaggtttttatattttctaaaaccatgatcatctgtttgctctgcccacttttatgtgggctatttttcttttggaaaggagccaaaggcgaactttcctataaagtaagaaaaaatccgattcctactgctcataggaaccggatgcttctttgcatatcgatcattcttcatacatcggtgtgtatggttctttatttcgttccctaaattcttttgtaatcttcgctaagacctgtggttttgtaaagagatcatatacgattcctgctgccactttagatgcatataaggctcctttatctccgatggaagtccctccgcttgcggttgcctgccatgtatgtggagagcatccaattggccagcatgctgtcgtaaacagacaggttggcataatcctgctgacatctcctgtatcagaagatgcacttagttctgcttctttccatttatctcttggcgaaacacctaagatcattgcttcatcataaacttggtgaagattttttcctttctctatgataccttgttccacggttttctgcaactcttttgcaaatcgtagttcttcttttgtgtatttgggtccatctgcttcaatcaggttcgcatatgcaaggtctgcaaatgcttcgtttgtggataactcacagcatccacatcccatttcaatatccactgtcgtctctgtcatcatcgctgcaccttgggctactttctttaagcgttccattgtgcttttgacatccttcatatgtggtgctctgacaaaataccatgcacttgcttggtctggcacgatattgggtgcaaatccaccgctgtctgtagaataatgaattcttgtgcggtcaatgacatgttctcttaaatagtttgctccaacactcattaattccacggcgtctaaagcacttcttccctgttccggagcaaatgctgcatgtgatgatactccatggaaataaaaatgtgcagatgcattcgcaagatatgcttgatcatgtgccatgtttgtatcagatggatgccagctcactgctgcatcacatccatcaaacatatgatgatatgccatctttacctttccacttaacagttcttcttctgggcatccatagaatctgactgttcctttttgtttccctttttctaagaaacgtttgatcgcaatgactgcagttgtagccgcggcacctaacatatggtgcccacatccgtgtccgacaccatcttcggataccatttcttttttaatatctgctttttgtgataatccaggaagtgcatcgtattctccaagaattgcgataactggtttcccttttccgtattctgcaataaacgcatgttctaaatgttcattgttctcaatcgtgaatccttcttcactcaagatttttcttaagaaattggcagattctctttcatttccagataattctgggtgattccataaagtatgacagatttcctgacacaacggctctaacccttgcacttcatcataaacgtcctgtttgatcattttatcccctgctttctattcctttgttgtattctttaatatcgccattccaacagcaatacttacgaagacacatcctaaggttccaagccaattggatgcccctggcaaccagttaaagtatcccattccgatcataaaatataagatgatcgcaaatacaaccataatgacgctgtgttttttcattttcattccaaattgtactaataaagctccaaataaagctggcagcaagtagtttaatgcggctttgatcgtatctggaagcatggataatacagaagttccaagaattgctccaattgtaagaacagatacgttaatcacgatagatactgccattccaagggttgcaacaacagatcctttttctgttcctggttctacatctgctgccacctgtgccatacttgcacatgggattctcatgttagagatatttcctgataagaatgccatataagttccagcagctccgacgactggaaagtaagagatcggttctacaaaccataacaccccaaaggcactggctccgctgataaatgcggttaataatgcagctggttttggtaagattccatagacaacagctaatacaagtgctggagtaaaggaaagaagaactccaaggtatcctgtgatcttaccgatcttattgacttgtggtacatattctttattataataatcctgattgttcatcgtatcttcctcctgcttaaactaatgctgtaatgatcatggctccaagaattgtgatcgtcagggaccattcttttaaccatccgatctcttttttatttgcaactttggtaagtacaaacatgatcacggctccaagcacacatgctaaggcattcttccatgctccgctcattgtgatctggtctgctttcatcatcatagagtaaaatggtttggataaatggcttgcgcacattgctgaaaatacaccgatgatcgcacaagaagcaatcgttgtcagtgttcctgtatttcctctggaaactttcttttcgatcttatccatcttatttgcagagaatgttgcgaataacgcccatccgatagagcaaagaatcatggtccagactgccattcctaaagcttctggtgttaatgtgtccgttccaagctgtaccccgacagcggatgttccaagtcctgctgcgatagattcaaacataacggatccaatcatagataatctcatccatccgattggccctcctacagatactaacagagaaagcatcgcacttaatacaacgatggatggtccaattgatgttaccgcactgcttttcattgcttttttcatctgtttatcgttaagtcctagtttctttcctgatttgtaagcgccccttgcgaataagactgcctgtaagatgacaaatgccactggaagtgcacaggccagccacattgggatactatttgcgattttcattgcgtccatatttttatcctccttatcggtccgtgtgttttgtatgcaattatattacctgttttgttggtgaaatggtatgaaaattttttcactttttatcggggcgtcttggtttttgaagatttttatgataaatatccttttgagatgaaaattttttcactctcctgtctttattttttgtaaattctgataataatcgagcaaaaaggcgttaaaattctaacgcctttttatgatctttattcaatttcttctccgtttgatgcaatgacttttttataccagtaaaaagattttttaggagttctttttaatgttccattgccttcgtcatctttatctacatagataaatccatatcgtttcttcatttcaccggttgaagcactgaccagatcaatgcaaccccaggaagtatatcccataagttctaccccatcttcttcaatcgctgctttcattgccttgatatgttctctatggtattcaattcgatagtcatcttcaacatagccattttcatctggttcgtctactgcccctaatccattttctacaataaataatggcttctgatatctgtcatataattcattcattgtgatacgaagacctaatggatcgatctgccacccccattcacttgcttttaaataaggatttcttactgttgcaaatgcatttcctgctgtcgtatcaatttctggatctgtgcttgcacaacgggaagaataataagaaaaagatacaaagtctgctgtattttcctttaataatttctcatctgcatctgttatatcaatctttatctgctctttttcaaacattttctttgcatatgctggatattctcctctcgcctgaacatcaataaacagataattttccctgtctttttccatggccttaaatacatcttttggatcacaactataggcatatgtttttccagctgccaacatacatccaatctggttatctttatctatctcatgtccgattctcacagccattgcagatgctaccaattcattgtgtgttgcctgatattttgcctgtttctggttctccccttcttcaaacacaagacctgctgccataaatggtaaatgcaggatcatattgatctcgttaaatgtaatccaatactttacgattcctttatatctggtaaataaaactcttaccaatctttcataaaaatcgatcagttttcgattcttccatccaccatattctttgatcaaatgcattgggcaatcaaaatgtgtgatcgttaccaaaggttcgatcccatattttagacattctttaaaaatatcgtcgtaaaacttcaggccttcctcattaggttcaagttcatctccctttggaaatatcctgctccatgcaatggataaacgaaatactttaaatcccatttctgcaaacattgcaatatcttctttataatgatgatacatatcaattccctgcattgccggataatcgtgttctttatctggttctaacatttgtttctttccaagacagatatccattctatcttttccagctggaatcacatctacattggcaagtcctctgttgccttcctgatatccaccttcacactgattggctgcggtcgctccgccccataaaaattcttttggaaaactcattttttctcctcctgtttctgatacaaaacaatctcaccatcaattccaaaaggttcgattggcagataatgactgatcgcatcacgaattgtcgttccaagtgtattcgttacttcaattgccagtttattttttccatcctctaagaattctgacaagtcaaatcgatatggttttgataagcgcacacctgctgaccttccatttacaaaaacctctaccgtttcatacgcattttcaatttctaatactgttttaccatttacaggcatcttgacgatcgtttcatatcgaagcgttccacttgctttttcccatccttccatctcctgaacagttttggcatgattgattggcacttcctgttcaaactcaggataagaaaaactgtcggcataagaaacactccattcctgtttgatctcttttttatcccattcttttttctttgaaaactcatataatgcattatattccatttctttgctctcttcatatggttttgtcatccatatcacagtttcatatggtgcaagattcaagacagctttttgatctactatctctaatttagttataacatttctgtatgcatcgtactgatataattgaggttctttgatttctatttcaatatgaaattcttttgaaatattttcattaaaaaacatccagtattttgtatcgtttttctcgtattctccgatcactaattctggttcttcaccctcgatcactaaactctgataatctttcaaatatttaccaagctgttttaattctacactttctgcataatctttttcatcatcaacaaagataattctaatatcatgttttgcaaatttctcaatgacttctttgagatcttctggcatatattccccatatggcaccactaaaacctcaaattctgtctgattgatcttgtatttaccatctgtgatctctgcttgttttaaataatctcttgttacaatatcaaatggaatctgtgactgtgtcagaactcttgctggtttttctactggcatataatctcccgcccattccatctctgctggatataagagtccgatctttgctggataatgtccatctttcataatgtccatgacacgatttacatagtcactaaaatatttgaaatatcgaaactgtggattatgtccatgtacataaaaatgtggtggacagtcaaagtccgggaatgattttggattaaatgcatgtggcaccagatagttgattcctcgaaccatcagatgatctgcaatccatttcatcgtctttaacccctcgttccatccataagctccaaatgcttcgcacatcgctcttcccttctttacaggatcaaggtgtgctgcggaacttgcaagtttggctaatgcataatgataaaactctccattacttccaccagtactgaatgcatcatgatgataattcattccaggaacgatctgacccccaatcacatcaattcctgcaaaatccatttcctgctgccctctgaaataatgtcctgttccatatccaagacgggcatgtgcaccattatcttcaatgttatgtccaagataccagacaccgtgatctttgcaccagtctgctaatactttggtaaaattttcatgataaagttctgtaatcctatccatatattgaaaccggatttctttttcttttccatttgcgtttgcccataaaagtggcagaaatctttcatcaaaccctatttctttttgcagaccttttctccatggtaataccatatccatacgtccaatggatgcctctgtaccttttgtatttccaaatcttggttcatccgagaaaaatccctgaattgtcttgccaaactcttctttgtaatgtttgtaatgtggctcataaacttcgtcgatcaaaacctgtgttgcttctttgaccaatggatttaaatagtcttttgtggattcttctccgccttttcttgtctcatatacaacaaagatactataggctccttcttttatatctactgttaataatctggtttttggatcaatgcagtctgtaatattgatcatactttccatatcaatctgatccccatctgattgccatggcgacattctttctgccatataaacacccagtatttcttctgaaaaatctggtttgtcccatggtctgccttttaaaagacttagatcaattcttgctttcttaagcggaccatggatatcatatcttctcatatcaagatataattttaaatattgtggatatgcttcctttacttttccattggcatatcctgtcggaaaatgtgaatcatccaaaatccacagcttcatagacaattcttttgctttgtttataatacagtctaaatcattccaccatccttctttcacaaattccgggtgtggacgtgcttcaatacatacgccacccattccactttctgagattttttccatatatgtttctaaaacctgatgatcttctccatgttgccaaaaaaatggatataatgaatttttcacgattcttctccttttcaaatatttattctacatttataataacatcgttttcttcgcatgctccattatgacattcaactttttgatattcatcactattgatcactaaagttacaacgatatcatcaaaatttgctgcttttatcttttctctgtcaaattcgatcagtttatcacctttttttacagcctgtccatcttttacaaaaactttaaatccttccccattcattttaactgtgtcaattccgatatggatcaacagctgtacatcctgatctgaaaccattccaacggcatgttttgtttctgttacagagctgatcactccatcaaatggtgcatacacaactgattcagaaggtctgattcctacaccttttccaagcatccctgatgcaaaagtttcgtctttgatctgatcttgtgggattgcagttcctttgactggtgcataaattttttgtcttgtttcttttttatcaattgttttttctgtaatttcaattttttctgcttcatctttactatttgttgtaaaaataaatgacacaaccgctgcaatgacaaatgcaacaactgcacatatgataaatccataaaaactgatatcaattccttttggattgatcattgctggaattctgaaaattccatctcctgcatagacgtacatttttccaccgagtgctccaagaattcctcctgcaactcctcctccgatcattcctgctgcaaataatctgatgtttgtaagtgcaatagagtaaatcgtaggttctgtaactccacataatgcagataccatattacctaatcccatactcttcttttcctgatccttatttttaagagcatatcctaatgctactcctgcaaatgcccatacagataatcccataatcgcattcactggatcatatcctaaagaaaacaggttattcattaagattggaataaatgccgtatgtaatccaagtaaaacaactaactgccagcaggcaccgatcaccattcctccaattaatggactgactccaaagattcccataactgctttggacagcagagatgataagatgttcataactggtcctaaagcaagccatgctactggtactgtaatgatcactacgaatgttggcacaaagatcaactgtaatacagaaggtatgatcttctttgccagtttttctaatttagatgcaaagaatgctgctaataaaattggcagaaatgtatttgcataacttacagatgttacatgtaatgtaaggaatgtcattccgccttttgcactaaccgcagttaacagattcggatataaaaatgcgcctccgatcactgctgttacataaggattacaattgaaaatctttccacatgtgaatccaactaagattggcatgaaatacataacggcatctgctgctgcgtataaaagaatatacgttccatctgttgctttgagtacacctgccgttgttaagatcactaaaagccctttgatgattccacttgctactaatggtccgatcatcggcatgatacagccagcgatcgtcttaaaaaagcgattccataagcttccttctttgactactttataagaatctttatccgctgccttactatctgtcaaatctgcttctttttttacatagtcaatcaggtcacttacatttgttccaatgatgacctggtattgcccaccttgattcatcacaccttttactcccttaatggaagctaccttttctttgtctggaatactatcatctttcagcacaaaacgcagtcttgtcatacaattaccaacactgataatattctcttttccccctacagctgctacaatttctcttgcaaactgtgtataatcaatttttgccatgatttttcctccattttgatttgatgttttgcaaaacaagtttatctgacagatcctattctttattatacagatatccagtagaaatataataacgaaatcattcaaaaacattgaccatttccacactatttgttatccttaaaaaaatgaaaaaatttttaggagatcatataaatggattatgaaacaatgaatcaaaaaatgtttgaattatcagaaagcgaaaaacgttatctgcatggtgacagctttgacggatggaaaaatgttccaacacaaaagctcgataagcatactgtatacaggcttcctgaccttgattacaatcttccttcgcattcaaaacatgatgaaatttattctctgatcggctctcacaatttattattaaaacgaaattccagatttaatgaagttcctgaacatgtacattcttatattgaattaaattatgtatactctggaaactgtcctcagacgatccatggaaaagaaattacattgaccaaaaatcaagttcttctaattgatacagactgccctcattctatctcttatctttctgaaaatgatattatgatcagccttatgatctcaaaggaatttttgaaagatcatctatttggacagttttctaaagaaagtattctttccagattttttatcaatgcgatcactgaaaaaaccgatcacgatcactatttactgtttcattctgaaaatgaccgccggatttctttattttttcaagaatttctctgtgaatgttttgatccgtctattaattccaaagatattcttcatcaccttttttatgttatcatcgcgcagttgatcaatatctacgaaaatgatatgtcacaagatcaaacctcagattcccagacttatgcatcttcgatcattcgttatatcgaagatcattacaaaacctgcactcagcagagcgtatctgaacattttcatatcagtcccaattatgtgtccagagtgttaaagaagcatatgggatttacttatatgcagcttgttcacgaaaagcggctcactgtagccgcgcaactgctgactcatagttccttatctgttacatccattgcaaatgagatcggttatgaaaatgtatcgttcttttataaaaaattttatcagaaatatcattgcacgccaaaagaatataaattaaaaaagacattataaaagcaaaaaaggacagtctgctcacatatgtgatatgactgtcccttcttttataaattatctttattttctttataaacttgtggaaggattgctgctaaatttgtgaactctttgatattgtgtgcaaataatccttgtggtacgatttctggaatcttaactccttctggcagcgtttttatgatatttccatccacaactcccattccaatccagaatctggaacaaaacatgactccatctttgtatggataccatttatgtgtcattgctgctgcacaactgctttcaccgatcgcacataccatagaactgcattttgatgttccaatattattttcatcgtatccaaaatctttcggtctcttgaaatttaattttaggaattctggtcctggtccgacatcttccataatataatggctgactccccatgtcttttctctcatcggaacgtttggatcacagacataatccacgcggtctgctcttgcaaaatagtgatcttctgggtcccagatcttataacgaagatcagaacctacactatgccatggaaaccaccagtcaagcatctctactgtgactttcggcatatatgttgcattacatacaaaacctgtgccatctttcatcacaccaaatccgatctggcagtaatcatcatcttctccttttaagaataaatctttttcttcaaaggaaaccatttctgtttttgatggtccttgctttaaaatttccagtttttcttgtggaactggtgctaattcctgttcaaaaaagcgataataggacaattgtttttcttctttgattactccgacttttttcatttttcatgacttcctttctctttatttttaaataccttgaccatttttctctgggcaatatctacaaacacaccaacataccagattcctgcaagcattgctgctgcaatctgtacaggtattgatccaagatgtccccatcctattggtgcaaggattgtaagtccaacggcccatccacataaccatgccggtgtaaagatccattttggaagacaggctgaaatcaatactgcaagtcctcctaaaacaaataatgttatgaataattccatatctgcattgaaattcattacatccataatctttaatgcaaagactgcccagaaatctccaagtaaaaatcctatggaaatcttcactgcatcactgctcttatttccatttgtgacgtaaagtccggcgcagattaatgcgactgcaccggtacttacattgatattaggggcgatcactgcccatattggagggaaaagagcaatacaaaatgcaagagtcaacgtttcaattgttattttatgtttcaattattttctcctctgcctcgtttcgatcaatttccattttatttagatgatttccattgcggctgtccatccttcacgaacagaatctccaatctgtcttgcacgaacacaatctccaatcttccatactggaatacctttttcgttgatcactgattccaaggcctctgtgctatggtttcttcttcccattgcattgactactgtatctgctttgagtataatttcttttccattctgctcggccgttacataatcttttcctacttttgtcactttggcgttgacttcatattttccaccgtgttcatcgataaaatcatggactgctgttctgtaaagtcctgtgatatctggcatcagagcacctttcatttctacgatcattgttttcactccatgatcaatgtaatctgcagcagcttcgcatccaacaagtcctccacctaaaatgatcgtactttccccaagtcctttgaaatcattattgtatacttccattgctgtcactgcattttcaattccttcgattggaaggatcagatcatcagatccaactgcaaggatcactgcttctggattgatttctttgagcatttctggtgttacttcacagtttaatcgtacatcaattgaacgtttattaacttcgcgaattaaaagatttttaaaattacggatatctactttgtggtctgtgtgatctgtaaaattgatcaatcctccaagaacttcggatttttcacagagaatcacctgatgtcctctatctgctgctgtgatcgccgcctgcattcctccacagccgccacctacaataagcactttacggcttgcctgtggttttggcattttatctggtaatactttatgatgagatgctggccatacatcataaggattgatcgtacaggaatctagtggtggatattttactgtccagatttctgtttcatgttctccagatggtcctggataacatcttccacaacgtaaacagcgtctgatctcatcagcacgtccttcttttgctttgtttgggaacgcaggatcagcaaagaactgtcttcccatagataccatatctacttttccagctttgatcgcttcttctgcctgttcaggggaattgattcctccaacaactgtcactggaactgatacattttctttaatcttggcagctgcatcaatatttaatccatgtggtgcatacgctgtactgaattccctgcttcttgaagaacttaaataatgtccacaagatacatggatcatatcaatatatggttcacacatcttacaatatttgatggcatcttctaattccagaccgccttttagatgttcagaactgctaaccctaatctcaatcataaaatcaggacccattgcttcacgtacacgttttaacagatctaccgtgaatcttgctctattttcaaaagatccaccatattcatctgttcgtttattatacattggagataaaaactgagctggaagccatccatgtccacaatggatcatgattccttcccatcctgctgcctgaaaccatttacatgctgttacataatcttcatagcagtctaagatttcttcttttgtaaatgcatcgacatgtgttccatcaggaagatctttctcagatggtcctttaggattgatcccatctccgatatctgttttaatctctccacaagaaagtaattctccaactggaagagctccataacttttgatcatttctgctgtcttctgaatgatattaaaaatcctgtcatctcttgaattataatctacatatggttcaaatggaaatcttttatcgtattcgtgatttggactgatttctccaagacagacgattcctgctccaccttttgcttttgcctctaacatacggtatgctttttcattgactggctgagtgtatccaaacggatcgtctccttccataaaatgctcaaatgcaaacattgctggtgctgcctcaatacggtttttaactgttttagaaccgatttttaatggttcaaataaatttggaaaatactgatttttttctgacatggtgtttcatccttccttaaaattactatcaattttgttatcttgactttaacaaaaatttatcaatcttatcaatcatcagctttctttcaactgttttattttgcaatacttccaacatttttgttgcattgtactgattaaaatgcacttttatttcttataggatatgataattatattatcttttctttgtgtttgtatggtataataatagtaatttacagaaaggataaaatgccatggatcaacgtgccaatcgaatgaaaacactgatcataaatactttttttgactgtcttgaaacgcttgattttacccagatcacaatcggaaagatttctgatcaggctatgatcaaccgctctactttttatcgttatttttctgacaaatatatcctgagagatacgattgttgccgatattgtaaaagattttgccgaccatatggaagttgattttcttcatatggatataaaaaataaagatcataccaaaacacttgaatatagtctttcacatctttgtacaaagaaaagagaattagaacttttgtggaatcaaccaacgcttggacgaaatgtctttgatgaaatgatcgatgcaggtgcttccaaagtagaaaatgagatcaaaaatcataagacgatcactcctgaaaagaaagcacttgctgactggtatgcaaaacttcttgttaataattatcttgtaactgtccgttggtggtttgctcacagtgatacggtcagtgcaagtcagattacagaaatgatggaacgtcatatgatatctgggacagtttctacgctgctatcatagtaaaattgtaattatctcaaaaaagaaaaactaccattttctcttaatatctaagatataaatggtagttttcttgtattcaaattatatggatgtataaaggataggctatttatttttcataaaggaattcttctggtaagtttacattgaaatcctttgccagatgtctgaagttatctggagtaattgtctgtaatttatctggtcttacagccaggacttttaataagatcgctgctgccttttcaattgtatgcatcagaccgaatgtgttatcaaagtcttctccggaacagaagattccatggtgtgcccatatgatcacatcgtattttttcattaatttgctggattctacggcgatatctcttccacctggaaccatccaagggatcactccgattccatctgggaagatgactgggcattctgtcatcatttcccataattctcttgtgaatactttgtcatctaatggaagaacgaatgttaatgcaatcacatttggcacatgagagtggtagataactctgtgaagtccgtttgttgcttttttcttcacttcgtgattcattaagtgagatggcagttcacttgttggtactccgccgtctacaagtccccatacgattcgatactgttttccttcggaatcgatctctacgatcgcaatattcttttctggtgctaatgctacatttctgaaatattttccagaacctgtcactaagaaatattctcctgcaaggtcaggaacttctgttccgatgtctgtaaattctttgtcatagctaaactggtctttgacctgttctacttcttctggtttcatacggtaacttgcatttccaccatttctctcatggaatcctaatgcgtaaccatcgtcacacattctgataaatccctgtacaaattctgcttctgttactttcattttctatgtctccttctatctaccaattatttacgttttgctaatacttctgtttcatatgctttgatctcgtcaaaccatgctccgtccactggtacgttgcattcttcacaatactgcgcccagatatctccaaatggcagtgtttttgtttcttcctgacgaaccatcagctctgtaaagtttccttcatcctgtaatttctgaagatcttcatttggtgttactaatgccattaataatgctttctggaagtttctatatcctacagtccatgcagaaatacggttgatacttgcatcaaagtaatctaatgccattttgactctgttttctaatccaccgcaacgtacgatttcttttgcgatttctcttgtttcatcatcaaatgccacaacatgatcagaatcccaacgaattggtcttgttacatgaagggcgatctctgggaagaatgctaataatgctggaatcttatcagatacaacttctgttggatgataatgtccgttatccattaatggaatgcatttatctttgttcattgctgcatatgttaaagcaaattcagcacttcctgttgtgtatgcttctactccgattccaaatactttggattcgatacatggttttacaaggttaaagtcatatggctctgaaaggatctggtcaatagaatctttgtaacgcattcttggtcccatgcggtctgctgggatatctttaaatccatctcctgtccagatgttcatgacacaaggaattcctgtttcttctgcgaagtactgggaaattctgatacatgcttttccgtgttcgatccagaattttcttacttcttcatctgggcttgataatgttaaaccatctttgatatttggatgagagaagaatgttgggttaaagtcaagtcccattcctctttctttggcaaattctacccagcgtttgaaatgttttggctcgatcttatctctgtctacatattctccgtcttcaaagatcgcataacttgcatgaacgttgatcttctttgttcctggcatcaggctcattgctttgtccatatctgcaaataattcctctggtgttcttgcaactccaggatagtttcctgttgtctgaattcctcctgtcaatggtccatcctgatcaaatcctttgacatcatctccctgccagcagtgaagggatactggtgctttttttaatgtttcgatagctttatctgtatctactccgatttttgcataaatttcttttgctgattcatatctttcttttactgtcatgatcttttctcctattttaatttaaattattaactatggctgatattttttaatttcaaatgattcactgatacattttcttgcatcttttaaatctttaaattctttgtttgctaacatctgtacagcaagatttccgattgctgttgcttccgctggtcctgcataaatctcacatcctgtttgttttgctgtgatcttatttaaatactctgcattggctccgccaccaacaacatagactctcttatatttctttcccgtatgttcttccatctgtttgatcgtatcaccatagcatttacctaagctgttatagatcacagatgcaacttcccattcgttttgtggtacttgctgatttgtgtcttcacaatatttcttcactgcaccgatcatgctttttggtgctaaaaacatatcattgttacaatcaacgatggatgggatcgtctgttttgatgccatatcacagatgtatgcgaaagaatattctgcttcaaattctttctttacggactggatcatccataatcccatgatattctttaaataacggaatctgtgatcgtatccaccttcatttgtgaagttatcctgcatactttctaaggtacaatctgcatccagaagttctgttcccattaaggaccatgtaccagaactgatgtataactggtcatcttctacggttggaattgcaacaaccgcagatcctgtatcatgggttgctggtaagatgactttacatgagaatcctacttcttcttcgatttctttactgaaatcacctacgatagttcctggatcagaaatctctccgaaaatcctttctggatatcccagacgtttgatcaagtcaaaatcccagtcatttgtctttggatttagcagctgtgttgttgttgcatttgtatattccgttttcttaactcctgttaataagaagttaaagtaatctgggatcatcaacatgttttcggcctgttcaaataattgtggttcctgctgtttgactgccatcagctgatagatcgtattaaagatctgtttctgaatccctgttcttttgtacaggtgtttcaatgaaatctcttcatatacttttgtatccattcctgtggttctgctgtctctatatccgtaagtttttccaagaatcttgtcttctttatctaacagaacataatcaaccgcccatgtatcgattcccatgtaagaaggaatttttcctaattctttgcattttttaagaccttctttgatctcataaaataatgcatcaacattccagcaaagacttccatccacttcttccattccatttgggaatcgataaatttcttctaatttcatttttccatcttcgatcattccaagcatatgtcttccgcttgatgctccgatatcaatggctaaataatattcgctcatgattctctccttgtctaaatttcctgttcttcatttgatggctttattatatctttcatcaagcaaaaaaattaggacacagcttgacaaaaactgtgtcctaattttgcaattatgtaatttttttgtccttatttgctttgcatccgatattcttttggtgatatctgatatttctctttgaatttgcggtagaaataactgctgttttcataaccacatgctaccatgatatctgcgatcggcaggtctgtctcacttaaaaacatacttgctttctcaaaacgtttctcctgtagtagttctttaaatgtatgccctgtctcctgtttaatcgttcttgatagcacggataaagactggtttaaatcttccgcaagatctgtaaggttagcatcccgatagtgctgatcgatgtatctcatcgttgtctcgatcaaaatatcatgataattcatctgtgtattcttttgcgctgtctcaattctgttaatgatctgtaaaaacacaagccccattgtatattgattgatcatttcatggtttttttcattcgtaaacagattcagggcaatattttccatcagattatctaccactggttcatgtcctaatttaaaataaagatattttgaccccgtatcattatttcttaacacgctgacaagaaattctgccagaatattgtctttattaagcattccaagtgggatatcaaagaactctgggagtgccataaaattaagaccaatatcatgaattccagcttcttcaatgctatgttttacttctttattcaaaaacaggatatctcctgcttccatgacaatccgttccccttcgatccagtttgcgatcgtcccctgacagacgtataaaatctcaatataattatgtccatgttccggaaaatcaataaaacgacagtgtttgcgtacacttaaatactctccctgccgaatcagtctctttgcgtccacttcgaatttatcttctgatgaataaatgtcccataccaccttctgcttttctccagataaaactctcttttcttcgtcggtgatcagttctaattcttttataacttcctcacgcatactttttctcctttttatccatactacatatgttatctttgtgatcataacaacaggaaaagcacagatgcagtgtatacatctgtgtttcctttgagttctcattattcaaatgggtgttcatgtgtttatggttttattatatcaaatttaaaactttacaataggacctttttttctttttttatgtctttattttactttttaataacatcagtgctttcttttcaatcctgcttacataagatcttgaaatatgaagtttttttgctacttctttttgtgtcattggttctcttccataaagtccatagcgcatgatcagtgttttcttctccttgttcatctccattttctctaattcttcatagattcttttgatattttctttctgctcgatctttttgatcaaatccgtttcctgtgttcctagaatatctaacagatggatctcatttccttctttatctatcccgatcggctcataaagggatgtgttctttgatgttttcttttcctgacgaagcatcatcaataattcattttcaatgcatcttgcagcatacgtgacaagccgatgacctttgctgatatcatacgtattgatcgctttgatcagcccgatcacaccgatcgagatcatatcttctttttccctgtccagattatgatatttctttacgatatgtgcaaccaaacgaaggttgtgttccactaacagatttctcgcattcatgtctccctggcggcttaggatcagataatgacgttcttcctctggtaataaaggttgtaaaaactcttgcaaaagaaaagcacccttctaagcctttttatcatactatgatactttgcttagaaaagtgcttttccatttctattctgaaatttttgccgatcttatcttaattctcttcttcgacttcttctcttcttcgaagcagatatccttctttaatctcttctccaaaatcaacatagatcatctgttttggatgtggtgcggattccattggtcttccgtcttcatcttcgatcgctttcactataacttctttgtttgttccgtctgggatcataacttcgatcgtctctccgacagagaatttattcttctgttctaagagtgcatatcctttgtcattatgtccctgaacgattccgatgtatgtgcagttcttaatatacgtattgctgtcatatatctgagatgtttcgtctgtctttccaaaataaaatcctgttgtaaactgacggtatgtgcatttagcgatctcttctttgtagtaatccatatttgctctgtatttttctacggattccttgcagtcatcgatcgcttttctgtaagttcttgcaaccgttgctacataaagagctgtcttcatacgtccttcgatcttcaagctgtcgataccggcatctaggatctgatcgatatattcgatcatatttaagtctttggagttaaaaatatatgttccacgttcattttcatacaccggcatatattctcctggtcttgtctgttccatcacagagtatttccatctgcaaggatgtgtgcattctccgctgtttgcatttcttcctgtgaagtagttacttagcaggcatcttccggaatgagagatacacatagcaccatgaataaatgattcgatttccatatcatctgggatatgagcacgaatatctttgatctcttccagagataattctcttgcagatacgacacggctcgctccctgatcataccagaacttgtatgttgcatagttggtactgtttgcctgtgtactgatgtggcggtcaatatctggacaaacttcttttgcaatcataaaaactccaggatctgagatgatcagtgcatctggtttgatctcttttaattcttcaaaatatttgcggattccttctaaatcttcgttgtgtgccacgatattagcagtgatataaactttcactccgtgtttatgtgcaaattcaattccttctttaacatcttccatggagaaattctttgctttggcacgtagtccatacatctctccaccgatataaacggcatctgctccatataacacagcaacttttaatacttccaagttacttgctggaattaataattcaacgtctctcattactttctcccatcttgatactgattgctacgccatcacctaccggaaggatcgttgtctctaactgtgggtgattcttgatcgtatataaatagtctctcattcgtttatgaatggtgcggtctcttcgctcgatcgcataacgtgatctggcaacgtctccgtcttgaagtacgttatctgaaaccagcacaccttctggtgccagaagtcttagtacatcatcaaggaaatgaatatactgtcccttggctgcatctacaaaaataaggtcaaaacttccatcaagtccttttaagatctcgatcgcatctccttctagtaaggtgatctgttcttcttttccctgatttttgatgttctcttttgctttcttgattcttttttcatttcgctcaatcgtgatgatcgttccgccttccggctggtaactgttcatataaagagaagaaaatcccactgctgctccgacttctaagatcttcatcggtttctttaaaaggaccagagtccttaagagttccttcgtctctggtttgacgatcggaacatgattgactctggcctctgattcaatatggcttaaatcgttcttctcttctttcatcaatgagcggatatattctgtgatatttaaatccactatcattgtatgatctcctctgatacatgatctccgcataaaatacccataatgtcatccattccctgagactgtgtaaattcatatgtccctgaaataaacgacttatctttgtattttgagaaatatttgcgaatcacaaatctagtctttccataaatcagtttctttgaaacaagggtttcggcaactttctcatctgactcattctgtgtaacaatgaccgttactttcttatggctttgtgcattatatggctgattcgaaaatgtctgttctgccacaaaatacgccccatagaaaatacagaagatcgcacagattaaaaatactctgcttaatgtcctaaaaaacagttgccatccttcggaatgaaaaaacttcttctcttctgaaagactcatcttaaacctctgtaatgatcggcaggatcattggattacgctttgtcttcttccaaatgtaattactaagctcgtctttgatcttcgtcttgatccttgcccagtctgtgatattacgttctaagcattcctctaccgcatctcttgcaacatctcttgcaccttccatcaaagattctgattctctgacatatacaaatccacgagatacgatatctggacctgccaggatcatattgccatgtttctgcagagtaactgttgcaatgatcaatccattctgagacagtaacttacggtcattcaatacgatgttaccaacatctccgacaccaagtccatcaacgaggattcctcctgcctgtacttttccagcgatctttccttgtctcttattgagctccagaacatcaccttctgccaatacaaatgcattctcctttggaattcccatctcgatggcaagttcacgatgacgcatcagatgacggtattctccatgaacagggattgcatacttcggcttcgtcagtgcataaataagtcttaattcttcacggcatgcatgaccggaaacatgtgtatcttcaaatacgatctgtgcaccttttaatgccagctcattcatgatctttgagatgttcttctcatttcctggaattggacttgagctgaatatgatcgtatcacttggtacgatggatacttttctgtgagttgagtttgccatacgggataatgctgccattgtctctccctggcttcccgttgtgattaaaacaatctgatcgtcaggataattcttaatctgatcagtttctattaatgtgttctttggaatcttgatgtatcctaattcggacgctgtcgcaatgatatttaccatgcttcgtccttctactgcaacttttcttccgtacttatgtgcagaattgatgatatgctgtacacgatccacgttcgatgcaaatgttgcaatgatcatacgtccttttaaatgttctgcgaacagattgtccagacgttttcctacattcttctctgatggtgtatagccttgtcgttctacattcgtactatctgccatcaatgccagaactcccttacttccaagttctgcgaatcttgcaagatcgatcgcttccccaaataatggcgtatggtcgatcttaaagtcacccgtatgcacgatcacacctgctggtgttgtgatcgcaagtgctgctgcatctgcaatactgtgatttgtcttaataaattctacattaaagattccaagttttactttgtcaccatgtgtcacaacatggcgctccacgttatttaaaataccgtgctcttttaatttgttctcgatcaatgccatggtaagttttgtcgcatagatcggtacgttcaattccttctcgaaataaggaatcgctccaatatggtcctcatgaccatgggtgataaccagtccacgaatcttgcttgcattgtcctttaaatatgtgatatctggaataactaaatcaattcctaacatatcctcatctgggaacgcaagtccacagtccacgatcaaaatctggttattgcattcaaatgctgtgatgttcattccgatctggccgagtccgccaagtggaatgatctttactgagctaggctttcttctaggcattggtcttcttccccttgcctgataattattcttattgtatgatttcttgttatcatttgcataataattatttcgttttggtcttgcctgctgtcttacttgattgtctttcaactttcttcctccatatctacgtaggtctgacaatccattgttttaaacactcttatatattttataaactcacttcaagtccatctaacagtgcgttaaaaatatctgagatcatatccagttctttatcgtcctcaacgatctcataggatacatagtcatcctccaactgcacttctttcatgatcaatacaacgctctcatcttcactcgatgcttcgcagtcttctaccaaaaggtaagtccgacctgcgatcgttgtctgttctatgacattaaattcgatttcctgtccatcgtcatccagaaaaagaatcttgctgtctttcttgctcattgtctgttcctcctatagggaatctaaatatccctgtaaaatcatagacgccgcgatctgatcgatcactttctttctgttttcgcgtcttacaccgctttccatcagaactttctctgatgctactgttgtcagtcgctcatcccacaagatcacttctaatcctgtacgacgcactaaggcatcgcggaaagataaagtatcttctccgcgctcacctactgtattattcatattctttgggagacctaaaacaatcttctcaacattatattctttcacaagttcttcgatccttgcgtaagtctttcttaacttattcgcatctttccttgtaatcgtctctaatggctgtgctgtaatatgaagctcatcacttaacgccactccgactgtcttcgtcccataatctaaccctaatatccttctcataataccacggtctctactttaatcttgtctcaatatagttctcaagcagtgcttcaatgatatcgtcacgctcgactttattgatgatgcttcttgcattgttgtgactggtaatgtatgttggatctccagacataatatatcctaccatctgattgacagggttatatcctttctcctgcagtgccttatatacacgctctaagatcatgtgtacatccagttcctctctaacaacagaaaaatgttgtgtttgattattatccataattatcacgtccctttcatttattaaccattttaatataaaatgtatgaaatagcaatggaaatcataaaatttcacatctgtttaacactctgccaatacatatccatcatctaagatctgtcttagctttactttcacgatcttattttccaatggttcttcactgtaaagtgcaacttttatatactcctttgtatgccctgtataataatgatcttttccatgcatcttttcttcgatcagtacttctttgaccatccctaactgttttgtctcaaattccttctggtgttgttttgacatttctaataagacattacttcgttttgccttaatctgatcattgatctgtggcttcatatctgctgccttcgttccctttcgaatggaatatttgaacacatgcatttcatagagatcgatttcttctaaaaattttcttgtctcttcaaattcttcttctgtctctcctggaaaacctacgataatatctgttgtcaatgctggatattggaaatgttcacgaattgccttacatttctctctgatatcttgtgttgtatacttacggttcattcgttttaagacagaatcacatccactctgcagggacagatggaaatgcgggcaaaaactttccatcttagaaaggcggtctaatgtatcctttgtgataaatccaggttccagagatcccaaacggattctcttaacttccgggatcttggcaatctcttctaacagatcgatcagtgtaacatctcccaaatcttttccatacgatgtaacatgaattcctgtgatcacaaattcctgacatccatgttttgtcagattcgtgatctcttctaacacttcttccatcttacggcttctgactcttcctcttgcataagggataatgcagtaagaacaaaactgattgcatccatcttgtactttaatatatgctctggtatgttcttttaactgttctacatgcaaagattcatattcctgatcatgcgcaatatcaataacttcgatcgattctgcggctgattccttctctcccatatgctcttctaaaatatggatcaagtctttctttttattattcccaatgatcaaatcaatatttgtatcttttgataattcttcttttccaacttgagcataacatccaactgctactacaacaacgtctagattcttcttctttgcgcggtgaagcatctgtcttgatttacgttctgccatatttgtcacagaacatgtattcacaatgtagatatctgccgcttctttcggatcgaccatcgtaacacctgcttccttaagcattccatacatggcatccgtttcatattgatttactttgcagccaagagttacaatggccgctctttttccttgtaaattcatacgattcctttcttgttgacttttatgacaaatacgagtacactatccttgttaattggaaggagtattatcccatgtatgatgcattgatcaaactaaattccatcaaagacctatactcgtttgtcgacatccttgacaagcactctggcacgtttgagatcgttgccaatgactatgtcgtggatgccagatcactgatgagtatgctaagcctcgatctttcgaagcctttagagctttcgtttgattctgatgaggcttctgttatactgtctcagcttcagccatttattttacgtgaatgatctctgtagaatcaatggcttctttcattaaatcatcaatcacatcttccagatgttcttctgatttcttaattctctttaaattaccctttgtaactggatgttttgcaacaaagatcgtacagcagtcttcaaatggctgaatggatgtctcaaatgttccgatcttctctgcaatatctacaatctcctgtttatccataccgatacatggtctgaatactggcatattacatacttcatttgtgatcgcaaggttatggatcgtctggcttgctacctgtccgatactttcaccagtgatcagtgcaaggcttccaccttcatttgcaaaatgttctgcgatcttcatcatatatcttctcatgatgatcgttaattcttcatgagggcatttctcatagatcgctaactgaatgtctgtaaagtttacaacatgtaaattaatcggtcctgcatattttgcaacgatcttcgcaagatctataaccttctgttttgctctctcgcttgtgtatggtggtgcatggaaatatgttgcatcgatgtgtactccacgttttgcgatcatatatcctgcaactggactgtcgattcctccggataataaaagcatcgcttttccattggttccgactggcattccacctggtcctttgatttcctgagaatagatatagatgtattttctcacttcgatattcaccattacctgtggatggtgcacatctactttgatcccttcaaatgcatctagtaactgcccaccgatttccatattgatcgccatggaatcaagagggaactgtttatctcctcttcttgcatgaaccttgaatgtaaaatccttgactggatactgttcatcaataaatttgataactgtctctgtcaaatgttccatatctttattttcttcgatgatcattggacagattccaacgattccaaagactctctgcagtgcttccacagcttcatcataatcgaactcatcctgtgcttcgacaaacatacgtccagattcttttcttactttaaaatccccaacgggtgccattgcatggcggatctgtttcattaatgcgtcttcaaacatataacggttcttacctttgatggcaatctcaccgtatttgatcaaaaatgcggttactttcatagtattctcctttattttcttactgtttcttttcttgtggtctttattttcttacaaatcttcgaagcattggtactaattcttttaatgctttgatcgtttcatcaacttcttcttttgtattctcaattgagaaactgaaacgaagtgttccatctttaaattcatcacttaatgcgatcgcatttaatgttccactgactgcctgttttttgttcgatgaacatgcagatcctgaagatacatagatttctctgtcttccaaggcatgtaacagtacttcacttcttaacttcttaaagctgatacttgccacgtgtggtgcttttccagaattgtctttgatatcctcaatctctttgatcctttcctgaaaatattctttgacttcacggatcttctcagcattttcatagtttttaccgatcatcttttcacatgcgacagctaatcctacgattcctggtacattttccgttccagaacgcattcctttctgctgtccgcctccgaaaatgatcggagagatcttcgttccttccttgatatataaaaatccgattccttttggtccatggatcttatgaccacttgtggataataagtcaattcccatattctttggaacgatcggaagttttccatatgcctgaatcgcatcgacatggaaaatcgtattcggattctttgctttgatgatctttgcgatctcttcaattggttcaatggctccaatctcgttatttaccatcatgcaagatacaaggatcgtatcttctcggatactttcttctaactgatcaagatctacgattccttctgaatctacatcaagatatgtcacttcatatccttcttcttccagatgatacattggttcatatacagaagcatgttctacctttgtcgtaataatgtgctttcctttgcggcgatttgccattgctgttccaatgatcgctgtattgtttgattctgttcccccagatgtaaataagatttctttgggtttggctcttaatgtcttcgcaattaattcttgtgcagcttttactttattctctgcttcaatacctttcatatgttttgcagatggattcccatatgtgacctgcattgcatcctgcattgcttctacaacttctggaaatacgcaggttgtcgctgcattatcaaaataaatcatgtcactttctccctctattcttctatcgtaaacatcaaaatagataaaactgtcattcctgctgtctcagttcttaagatacgttttccaaggctcattgtctgaccacctgctgccttaagctgttcgatctcttccttttcaaaaccgccttctggtccgatgatgatcccaatcgatttcttcccttttgcctggctgatcagttctttggatgcctgcattccttttgcctcttcatatggaacaagcatgaattctgtatcttgtacttcttctaaaatatctttgaaatttctcacttcacgaacttctggaatgatccctcgttttgcctgttttgctgcgcttaatgcgatcgtattccaacggcttaccttctttgctgccttcttcgcatcaagtttcacaacacaacgtttcatggcaactggaacgatctctgccactccaagttccaccgctttttgaacgatcatctccatcttatcgccttttggcagtccctgatacagcgtgatctttactgggagttctgtttccatgccatgaacatcttcgatcttcgcaagaatcgtatcgtccgtccattccaaaaggctgcattcatattctaaatctgatccgttacttaaataaactttatctcctgttttcatgcggagaacgttcttaatatgattgacatcacttccacaaatctcgatcattccgtcatgaatctgttcttcttttataaaaaaacggtacatctcttacctcatcttcgctgtcatagaaacccagtctttcattcttcttgtctcaatgacatcaaatccatatgcatttaatttgtctgcgatttctttttcttttgtatcaatgataccagagattacaaaaacaccatcttctgccaaaaactgatctacgatctcgatcagtggtgagataacatctgctaaaatattagcaacaacaaccggataacattttgatcctaaggatgctgcaaactctttatcatctaaaacatttccctgatatacttcaaactgatctttgctgatatggtttacttcaaagttctcctcagaagctgagatcgcatgtggatcgatatctgtaagaaccgcatgccctgccccaagtttcagtccgatgatcgacaaaattccacttccgcatccaacatccaaaatctttgtatcttccttaatatatggtttcattccttcaatacaaagttttgttgtctcatgagaacctgttccaaatgctgttcccggatcgatctctacaacaatcatatcttctgtctgatcttctaatgtctcccatgttggtttgatcacgatctgttcatccagacgaatcggtttaaagaatttcttccagttattgacccagtcttcttctttcgtcttatcaaatgaaattgttccagcaccgatatccataaatccacgaagtctttcaagcattgcctgaatctgcattgtaatgtgctctaaattttcattctcatcaaaataacagctgatctttgcttttccatcgtctggtgcgatatcatctggcaatagatccacatacatgactttcatctcttcttctgtcaatgatacatggtcttcaacttccacaccagttgcaccaagttctgtaagttcataactgatcatgtcttctgctgatgtcaatgtatcaattgtaattttattccatcccatgacactgtatttcctttctctttctatcttatatttttatttcgtattcataacatatcaattaattagtgtatcatacaaaaagctggaatacaagaaaaaagagaatcccgtcgtctttcggaactctctttcatcgctatcttcttaatacgcaaactgtatttatgatgaatttatgcttctaagatctttccatcaatggaaattgtgtgaacctgccatggaaggaatttgccggaatcctgaatcgctttcttcgccgcattttccagcccgccacaacaaggaacttccattctaacgatcgttacactcttaatgtcattgttcgcaatgatctgtgtcagtttctcactgtaatctccttcatcaagttttggacagccgatcaatgtcactttatttttgataaatttctgatgaaaatttccataagcataagctgtacaatctgccgcgatcaatagattcgcatccttaaaatatggggcattaacaggtactaatttaatctgcaccggccactgagacagctgagaagatacagttgctgtctgctctgtcgctacctcttctgccttatgatccatgatcttcattcttgttccagggcacccgtggaataccggcttttcttctattttatcttttgctgtcatttcagctttcttcttcatgtttgcttctaccgcttctctgtcatacgcagctgcctcacgctctacgaaactgatcgctcctgttggacaatttggcagacagtctcctaagccgtcacaataatcatctcttaataattttgcctttccatcaactatcccgatcgcatcttcgtgacatgcatctgcacacagtccacatccattacatttatcttcatcaatttcaataattctacgaatcatatctattctccttttcttgatctcatattctttactgtatcgttagtataatagatatgatttgggaaatccgttgtttttacaacatttttaaaatttttttaaaaattgaaaaagcagaaggcactccataaaccttctgctctttcggttgtttattattcgaatatgccaacaaagacatgttcttcctgactatccgacgaaacaacactccatattctcttcgtaaaatctgttatacatctgtcgcatcaaaggaatcagtttataaagtggttccgtcttacgatggttaacttcatctttgatcatctctttgatgatcgcttcttttacctctcttagagtaccatatactccaactttttccaatacttttttgcaattttctttattctttgcgcgttttagtaatacaaaatctccataatatttttttatataataattttctttcattcttatcattttaaagttctccttttcacatactgtgtttaaaatcattgaacgatttcaaaaactttcttgaactgattattggcattatactccttttgtatacagtatatgttgcaaaagaattactttttatttaagtttttcttaatttttaatatatagatttctattatatccttatagatatttttaaacttgtatgttgtatacagtactcgtccatttttgacactttacaacctactttctttctagttataatatattataagtgtcactagtataaattccgtttgtttctacacaaataaacaatttatattcaatgacgaaccaaacaacaagaacggattaaaacatatagaaaggacacaatttatgaaatacaaactaatcgccgttgacttagatggaactctttataacgaccaactcaaaattacttctgatactttaaataccatgattaaagctcaggaaatgggtatccgcattgctcttgcttctggtcgtcctctccctggtctttttcatgccagagatttattgaaactaaatgaacatcatggaatgctcgttgcttacaatggcggaaaggttgtagatactactacaaatgaagttttatatgataagtacatcccagatgatctcgcaatggagcttttagaacatttgaaagattatcctgtaaatccgatcattgatgatgggaaagttctttatgtcacagacaagaatggatatcgcgtcaaagaagaggcattgaatgattctatggagtatgttgaggttccttccttgacagaacatcttgattttcatttaaataagatccttactgctgtcgatcctcaaaaaacttatgatgttttagaaacgatcggaatgccatttagagatcaggtcacttttgtccgtactgctccttattatattgaagcaattcctgtgggtaccagcaaagcttctggtctttccaatgtatgcaaaggtcttggcattgattcatctgaggtcattgcttttggtgatgcagaaaatgatctggaaatgatccagtttgcaggtcatggtgtcgctatgggaaatgcatgcgatgctttaaaagatgctgctgatgaagtaacacttacaaataatgaagatggtatcgcacatactttaaatcatttactgggctgccgttaacgacagccctctccagcacctgtttctcacaggcatacctcacttcaacacaatcagtcacccattagaaacgtgtatcacaaacagttttttgtcatagaaccacaatcacaacacaaatcatcaatataattgctgttataaacaagaataaattctttttagatacgttgtttcgatattgggtatactgttcacataaaattccaattccgaaaaccaacaatagaaaactctctaaaatcctaaacattccataaactccttctaaaatttacattgcgatttaatggtatctattccaagtataatttcacacagatttttaaatgagcctcctatatgccgagcatacttcttcgcatcacctgcggcataagccaacacaaccaattttgcagcctttttaactccgcctagggtcttaatgtattttactacttttgcaactttcgctgccgcaataactgtacccgcaacgatcaaaccgattgcagctgcacattttgcaattttccatgcagatggatctgcaataacaggaaatgtcgttttttcatcaaaattaacaacctgtgttaaaatattttcgttgacaacatagtaggtatccacatcattcccatttgcatcaacagcccatgctgcatcaataactgtatctattacgttatctttattaacaatgtaaacttcacctgtatcataatcattttcatttaccgcttcattgtcaattatatcacaataataatcttttgcagttatcaatgaatatccctctggtagatcataagcaaaagtatattctttagatgctgtagattcattaatagtaataagtgtccttactccctcaaaagaaacattaccagtttcatcttttagcggttgcacacctattgttactgcatcatcttctttaccatatatcattgttccattcttagtcaatatcccatcatcatcactagcctcaatgggcaacttcatctcaatggtcgccctatatatacccattccgtagaatgactcgcaagaatttcatctaagtctacttttgttatttctttgatattttttgagtctgacgattgtattttgatttttgaattactagtaaccaaacatgcaatcataaaaagtaccctcctttaataagagaatatcataattctgcatattttccactataactccgtcaacggtcgattttaaatttaatattacctttgtagatacttcttctccattaccttctagagaaaatcttccattatttcgacacactatttcacgcacatttctaagtcctataccatgatttttttatcctgttttttggtcattatgttttttcataatcctctataagcacagttgaactatttctgatagtaatcatcaaataaacctttcccgtctttatctcaatttttatatatgggtttgtgcatgaatatgctctaaatttcgaaattctacaactggtcccgttttgaaatgatatccactggactcaaaagaatctgtcatatcagacattatatctataattttaagatcattttcattttctggtaaaagcagatattgttctgatcctttaaacttaatttgatctgctgctgcccaaaaactgtttcctatatctaaagttccgtctttaagaatattaattttaattttctcattttgaatctgtcctttttctccatataagatcattgtctcctgaagaactttctctccctgaaaaacttcatcacgacttgaaaaaaggtcgatttcttttatgttcaattctttttgtaagaaattccttacttttgtaaaatattttccagaagtccatgaacgaggagtaataaaaatgtactgtccattatcgcataacaattcaattgctttcgccataaacaatccatacagattaggctgtccatatacatatgtcttcattgccgttgcttctacagaatcttttcttactttcatatatggaggattgcatatgacaatatcgtataaataggaggattcccataatatgaagttttgatcaacataatgaatgaaacattctgcatgatatgattcacagatttgcctaattttagtaattgtatattctaagactggcaaaatctctttatctgtttcaatcagtgtaatatcaagccgtttatacccacttcttagtaatttatcaatcacagcaaaagataaaatgccgtttcctgctcctggatctaatacccttatccattgattcttcggatattcactttctacagcagccattctcattgaaacctctgccggtgtaaaaaactgtccttttttctttcggatttccttttgtgttgtatctttatattcatttgtgtacatttcgattgtacgcaacattatcaatagactcctttatatcattgcaataaaagagtcacactgccataacatttgggaatgtgactgtttttattggttatttgtttcaatccacggttggtaatttcacagagtccaacatgtcgggaataccgacgttgcttgaccttatgtccgtaggggataccgatttctctccgcccgctactgccgtttcatttctttttgataattcctctcctacctatgtttacacctagaagtaagagattccttattatttgtttgttaaataaacgtataaattatcagatgaaccataatcagttcatttacagtttatcattaattttatttttgtgcaataaaattaatctctttgcaccaaaagaatatttttttaaaaatcccacagccaaaagactgcgggatcatccttcttactctttccacaaaatgagaaggctcctataagttttaatgtctgttccagtccattctttctgctgacacctgtgacacggttctggtcatcataagtataggttgtgacatttctgttcccatcatctgccgtcttattgataaccgtatcttttcatttaactatgtttctttgttttattgcacctcttttttccgacttcgtaagatccacgagaccttaaatttgtatcctacctatttcataaaatctattctattttctttacataaaaagcaactaatatattcaaacaaaatagaaaaaacctagcactcctcctaaaactataaaaagtattttatatttcatatatttcttacctgtaaggcaaaaaactattactaaaattaataaattgataataattgctaacaaaaattggttctcccattgataagaaatcaaagtaaatgaacaatacataacaggtaatcctgataaaattaatgataaaatgccttctttatgataataatatagaattattcctagtcctccaaaaatcacaggaataataatcgcttcacctaatccacataaaatataatcataattctgttttccaaattcaaaaaaaagttctatattcttaatccatgttgaaccaataacaaatgataatccaaatatggcacagtttatacctaattttattttctccttagttattaccataataatcgtaataactaacacaataaaaacgccatcacctagaatacattctaaactgattgacatatctgttcttcttgatgttaaatatcctagtacaattccacacaacaaaataattactttttttaaatacattacaattttctccatctctatatctcctcttttttatacttcaataacatcattaaggtttatatttttttaatggattttcatgattataataattttgctttcctccatatctaggataatacacttttttctttttatcatatctataagataatccatatggataactagatgcatacacaacacattgacattttttagccataattttagccacactatttttgtctcctattcctcccttacatgaaagcaatactatcttcttttttatttttttcttttttaaagctaacaactcttttaaattcatatcagaaccatcaaaatacaaacaactaaccccaccatgcaaatataaatataattcagatgttccttttggtattttatcccactcttttttaaattgtgcttttttaatcacagatttaaatgtaacttgactattcttataatatggagaatgcattgcttgtttcttaaaacccttcccttttttattataataaattactgttttagccttatgtccactaggatccacataattcaccggattattcgcacaataagcatataaatgtcctgtctctggtttagcagtctctcctcgataagtatcctctgtcacaaaccgtccatcttctggattataataccttgcattcagataataaagccctgtactatgatcatagattcctccagtataacaaacctcattctctgctttgttatctccgttgatcgttgtctctccaaagtctgtataccggtatgttgcatcagcacttccatcttcttttacaagacttgtggtacttccctggatatctttatgatacaacagatagtccgtatggtcacttccatatctctgtgttgcaaggatatttccgtcggttccgatcaggttctgggatgtctggctgttctctccatcggttgtgtaagaaactactccgtcctgatagtaatagttcgtcgttttgcttccttccactttctggatcctctgtccttctccgttataacggttctgctggatcacagctgtctttccatctttgtcagttaccgctactttgcttaagcggttctctgcatcataagtataggattctgtctgtccagtctttgtgtttttgacatctgtctgattcccattggcatcatagctgtactggcggacttcgtcaactgcggttcctttttcttttgttgctgtctgtaactgatccagtccgttataggtatacgctgtctgtgtggttccatcatcttctttggttctgtttccagctttgtcataagtataggtaacggtctttgtcctgtcatcattcttatgatcggttgtcacagtctttgtcagtcgtccgagtgcatcataagtataggcttttgtctcattgactttgtctttctcttcttttggatagttgttgacttctgttttctctgtgatattggaattcttgtcataactgtagcggtaggattccatcactttgcctgtctcaagatctgtgtaggtcatctctttgacacggtcaaaactgtcataggtatagattttttgaactgcctgagcaccgttctttaaccgatttctgtagtccttgatctctttgacctttccatacgcatcgtaactgtaacttctgaggactttctctgttgtctgcccattggaatgcagttctcctttgatctcctgcagccatccgttttcatcataaatataagataatgactggattccgtctttggttgtcggataggataccttactgagatttccatcctcattataagtataccggatctgatgtgctttgatatcatctgccgttggctgagcattctgactgatctctgcaaatgctgtgatccttcctctttgatcataagtatattctgtataacgatacgcagtctctgtttcagatgataccctgtaatctgtcatctccagcaactgcccataatcatcataacgataccgactgatcagtgtttttgttccttctttgtcataagattgtgtttttacaacaagattccggctgttatattcataggtctttttcgccccgttggcatagacttctgaaatcttatttccacggtcatcataggtatactttgttgtaatggattcactgccgtctccaagatccgatgttgttgtcactgatccggatgcactggctgtttcctgcttgacatgtccattcgcatctgtaacgcttgttgtcgttgatccgtctgaattcacctgataggaaacttttgtcttctgtcctccctgtgtgatctcggttacacgattctggtcatcataagcataagatatctgatctccattgccatcggtttttgttgtctcatttccctttgtgtcatactctgttttctgtaagatggaactgtttccaacctttactgtggcatcagaagtcccttttgtaatctctggattctggatcgcagctgtctgttttccttctttgtcatataactgcaaggcaatctttccatctccggaagtctttgttccaagactgatcgttgcgatctcttttccgtcactggtgaacacatgatccgtatataatccatggctgaaacttctgacggtctgccccgctgcatctgtccatgactttttactgacacgtccattggtctttgttgtctgaacgctcagattctgatagtttttcgttccattcaacgtatggatctgtgcatcttcatatccataggcagtttccgtgacggtatctgtcccatctgctgattctgttgctttgatcacgcggtttagtgaatcataacgatacgctgtctttattcctgatgcactggtttctgttgccaccgttccgttatcatcatatgttttggattctgtctgtgtcacgccatcggatgttactttcgtctgtatcgctcttcccatgaaatcatacgatgtttccgtactgcttaagatatttcctttcctgtccttactggtattttctgtttcacgtcccatggcatctgtttttgtcacagatgtctctttctcttctccctgtgtcgttgttgttgtccgtgtcgttccctgtacagtatcctgacatgtcgtttgttctacagaatcaggggctccttcctttgttgtcgtgactgttgttggctgtccgtgatcatcataggatgtgactgttttggtttcttctttttccttgtctgttttcaaaaatttcaccagtccggcagcatccagctcctgataatccacttccgttttgatctttcttacaagatattcatttacccagccattttgttctccgccttttcctccatcatcataactgtaactgctttcaattccattggcatccttctttttcaggatctttcctgtattcttgtcaaaactcatggaatcctgtgctgttttgattccgtctgccttgtgggaagataccgtcgttgttccatctccataagaaagctgctggtattctccattcggacggataaatctttctgctttttctcctgtataagtgatctggtacccgttcttctttgcatcaatgatcttgctcatcttcccattacttccataagcatatgcctgatctacggaagctgtttctctgctgtttttgtgagaaacatttgcaagtttcccttcatcatatgaccgaggattcccactctagtttcctaactatgattataggctctcaactcacaattttcaatggcttcttttcctttactcttgacggagaaaaggcatctatgatagtataaagtttagtttcacagattacggaccatttgaaagggataacgactgtagggcacattttttgtgctcctgtcgttgtcccttttttgtgcacatattaaagaaaaggaaggaaagagacatgtatttaatgattgataattatgactcatttgtatataatctgaaagcttattttgaagagcttggaaaggaaattgccgtcatccgctgtgacaagatcacgctggaagagattgaagatatgcagccttccgggattattctctcgccagggccaaaacgcccgcaggacgcgacgctttgcatcgatattgtagaaaaattccaagagaaaataccgatacttggcgtctgcttaggtcaccaggtgctaggactctgctctggtgcaacggtggaaaaagggatatttccgatccatgggaaaatctctgagatttccaacaatgggcttcgtctcttcgccggtcttccgacgaaattcaatgtaacaagatatcattccctcgtcgtaaataaagacactatttccaataactacagcatcgatgccacaaccgcggacggtgttgtcatggggatctctcataaaacgcttccactatacggcgtacagtttcacccggaggcagtatgtaccgaatatggacatgcacttttaaataacttttgcaaaatcgcagagcagcgaggataatggaggatttttttcatgcagaacacgaatacaataattaaaaaactagatatgtacattccggcagctaagatttttcaagtactgccttccgaagaaaatgcgatttttctcgattcttctcttgtaaatgagcttggtcactattccatcatcggccgcaaaccttatctgaagcttgaaaaacgtgaagatcgtttttatattaatgatacagaagaaacctcgatttctttcgaaaattatctgagatcttatctggataaacagaaaactgcgaattcttcccacctgccacttgcgtcaggtgcacttggatatttttcttacgaatatggccgtaggctcatgggaattccatcttcccacaaagacacaatctctattccagatgcagtactcatattttacgatgcatttattattgaagattgtcacaaaaaagagagttacctcattaccaatggaattaccgaacctgctgatatacttttaaaaaaattggaagatgccattttaaaaacaagtgacagtgaacctgtaaagcctgtcaaagaaaaatatccgatccaggttcatgcaaactttgaaaaagaggattacaaaaaatcaatcagcgatatgatccactacatttacgaaggagacatttatatcgccaacatgacacagcaactgacgattgaaagcaaaaaagcaccacaggatgtattttacaatctccgtaaaaataacccttctccctttggcggctatttggattttgatcattatcagattgtatgtgcttcaccggagcgttttctaaaactcactgacggtcatgtagagacaagaccgatcaaagggacccgcaaaagaggagaaaccgaaaaagaggatctgcgtttgcgaaaggaactggaaaactctgaaaaagataaaagtgaacttcttatgattgtcgatctggaacgaaatgatctgaataaaatctgcagaagtggcagcgtgaaagtaactgatttatttaccatcgaagaatacgcaacagtctttcatctcgtatccgggattgaaggtgatctggcggacgagaaaaactttgccgatcttcttatggcgacatttccaggtggttctattactggtgcaccaaagtaccgcgccatggaagtgattgacgaactggaacatggaaagcgaaatctttacaccggctcgattggttatctttctctggatggaaactgtgattttaacattgtcatccggactgtcttgcacgtggacggtcactatcacttaggtgtcggcggcggcattacagcggaatcggagacagaatttgaatacgaagaaacattgcagaaggcaaaagctatccttgatgccctgcagtaatatggaaatgataatacgaaaggaaactaacatgaatctgcatatagatgacggagtacaattcggactgggtgcctttgagacgatcgcagtggagaaaaacaaacctgtttttcttgaaagacatttacaaaggcttcagcacgcagccgatgtatttgatcttggaaatttagaaaaccgccaggttaccgtaaattccattgaagattatttgaacagtacttatattgaacatggtgcactgaagataatattaacgaaagaaaatgtcattttttctgaccgaaaatcaccttatacaagtgctcattatgaaaatggttttacttccgcaataagtagcataagacgaaacgaaacatcccccttcacgtttcataaaacgttaaattatggcgataatattttagaaaaaagagctgccataaatgctggcatcaatgagaaaatctttctgaacacgaagggtcagatctgtgaaggcacagtgagcaacattttctttgtaaaagaaaagaaactctatacgcctacactctcctgcggcctgctaccgggaatccttcgggcatacatactggaaacttatgatgtcaaagagaccatcctttatccggaagatcttgtgacatttgatgagtgctttctgacgaattcactgatggggattatgcctctttttcagattgaaaatgtggcttttaaagaacgaacggtaacaaatcagcttcgtaaatcttatctggaaatgtatgtcaaccacccggggatgtaaccataggcatgctgtaccgcatgtagatgcttttgcatccagcgaatgagtacatttaaacataaaaaagcctccaatccaaagttagattagaggacgaaattaattttctggtattttatgtgacatgctcccaccacttaaatccctgattttgaagtgggggcttcttgctcaatggctttactgagccaagtatctacaagctatcctcgcgtgctccgcgattcttttgcccggacacgggcatgttttcttattatccaattgtccggatacggacagtttatgctgtcaacatccttcttacctcttcacggatgttgatcgctgcattatgatctctgtccatcttatttccacactcacagtgatagatatgccttttccagatgaagctggacatttccagtgccagcgaatctacttctttcagaaatggatattcccttttatacatggccggtgtgttttttaacattttctttgtcttttcatactctcgaatcttatcatcaagcatctgattgtacagaaaacgacaacagccaaatgttttgccaagaagtatcttctgttcttcggtcggatagatccggaaacgatatgctatgttcaatactttttctctccctgggtttcaatgtattgacggatcacttctactggagtgcctgctactggcacttttataagcattgataaatttactaagttctgttctcggctgcgcacggaacattattacacttcatttttaatacaaacatccaatttctgatatggtatctcgattccttcctcatcaaatcgaatcttaatctcttcatttaacgcccatttggttgctacataatcagatgttggaacccagcacctgatccccatcatgacagagctgtctgctaaactgctcacaaagatattaactccatcctgatcaagaattcttttttcattttttgctatgtctgtaagaattcttttgacttctttaatatctgcatcataagagatcccaacttcaatatcgatcaatcttcgttcctgttttgtgttgttgatcagatttgaattgcttaacgttccgttaggaatgacgatcactcggttatcaattgtcttaagctttgtatagaaaatatccatcgctgcaacttctccttcgcagtcggttcctgttaatacgatgtaatctcctacctgaaatggtttcaggattaatagtaaaactccacctgctacattagaaagtgttccttgtaatgctaaacctactgctacacctgcagatcctaataatgcgataaaggagcttacctctacccccatatgtgcaactgccataaagattacaatacaacgcaatccaatccttatgaaggagcaggaaaatgagataactccataatcgatctctgccttctcaagggttgtttttaacaatttaattaagatcttgatcaatttaaatccaattgcaatgatcaaaaatgatactatgacttttcctatgatactcattgcaatttccagatatttttctaaaaactgattccagttaatcttacccaagtccactactgcgaacatcgcttgtatttgtgctaacataaactctcctctttttttcttgtgtttcttttggtattcattttacacatatgcttaacataaaagaaacacgtatttctacgtgtttcttatcatagcaagtttatctattcattacaatacttatttttttgtaatatatccttttgcctttaatgtctcagcacataaaacagctccacctgctgctccacgaactgtgttatgagaaagtcctacaaatttgtaatcatatacagtgtcttctcttaaacgtccaacagagattcccattccattttcgtaatcaacatcttctcttacctgtgggcggttatcttcttctaagtactggatcatctgttttggagcacttggaagttctaattcctgtggaagtccgctgaagtttactaatttctcgatcaactgttcttttgttggtttcttcttgaatttaacgaagactgctgctgtatgtccgtttaatactggtacacggatacactgtgttgtgatcactggtgtttcagctttcacgatcacaccgtcttcaatatgtccccataaacgaagaggctcctgttcgctcttttcttcttctccaccgatgtatggaatgatgtttccttccatctctggccaatctttgaaagtttttcctgctccagaaattgcctgatatgttgtagcaacaacttcatatggttcaaattctttccatgctgttaaaactggtgcataactctggatagagcagttaggttttactgctatgaaaccttttgttgttcctaaacgtttcttctggctttcgatcacttcgaagtgttctgggttgatctccggtactaccattggtacatctggtgtccagcgatgagcactgttgttagatacaactggtgtttctgtttttgcatagtcttcttcgatctttttgatctcgtctttagacatatctactgcactaaatacaaaatctacgtgagaagcaacttcttctacttcattgacgttttttacgatcatagattttactgcttctggcattggagtatccattttccaacgtccaccaactgcttcttcatatgtctttccagcagaacgagggcttgctgctaatgttgtaacttcaaaccatggatgattctcaagtaatgaaataaaacgctgtccaaccattccagttgcacctaaaataccaactcttaatttttcactcattttttctctcctatagtacacgaacacgaacgactccgtcgatctgttccattttcttgattgtctcttctgttggtgctttcttttccatgtcaaacatagaataagcccattcacctttggatttattcaacatattggaaatgttatgtccatctgctgccaagatcgctgttaactgaccgatcatatttggaagattcttatgatgtactgtaatacgagctgctccacttgcttctccaagatcacagtttggatagtttactgaattgacaatattaccattctctaaataattcatcaactgatccactgccatctctgcacaattttcttctgattcttctgtagatgctcctaagtgtggaattgtgatcactttatctactccagcgatttctgcacttgggaaatctgttacataatgttttacttttcctgatgctaatccttcgatcactgcctgattatcaacaagttctcctctggcgaagtttaataatgtaactccgtctttcatcttatcgatagcttctttgttaatcattccttttgtagaattcatgtatggaacgtgaattgtaatataatcacatgtctcaaataattcgtcaatggaagcgatatgttttaccattcttgataagctccatgcagaacgtacggatacgtatggatcatatccataaactttcattccaagacgattgcagatatttgctactaaaacaccgattgctccaagtccgataactccgatactttttccttttaattcgttacctgcatactgttttttctgtttctcaacaagttttgcaaggttctcttcggatgcattttccttaacccagttatatccaccgatgatatcacgagatgcaagtaaaagtcctgcaacaacaagttcttttacaccattggcattcgctcctggtgtgttgaatgctacgattcccttctttgcatattcatctaatggaatattgttaactcctgctccagctcttgcaactgcaagaaggctttctggaactgcaagatcgtgcatagctgcacttcttactaaaactgcatctgctttatctaagtcatcgatcactttaaaatcttctgtaaataaatctagtcctttacttgcgatcgggtttaagcattttactgtatacatggctcctccttatttgttctcttcttcaaacttcttcataaatgctactaatttctcaacaccttcttttggcattgcgttataaatacttgcacgcattccaccaactgtacgatgtccttttaggttctcaaatcctgcttcttttgcttcagctacaaatttggcatccagatctttgtctcctgttacaaatggaacgttcattaaagagcggtcttctttcacaactgttcctttaaacatttcactctggtctaagaaatcatataagatttttgctttttcttcgttacgtttcttcattgcagtaagtccaccctggtcctttaaccatttgaagacttttccacagatatagattccgtagcatggaggtgtgttatacagtgaatctgcatctgcctgtgttttccattttaacatggttggtgttccttctaacacatcatctgtaatcagatcttcacgtacgatacaaactacaactcctgctggtccaacatttttctgtactccaaaatagatcactccaaagtcttctacattaactggctcagataaaatgcaagaagacatatctgcaacaaggattttaccttttgtatttggaatctgctgatattttgttccatagatcgtgttgttatagcatacatatacataatctgcatcttctgatacaggaaggtcagaacaatctggaatatatgtatatgttttatcttctgatgaagctaaaatgtttgcttttccatatctggaagcttcctggtatgctttctttgcccactgtcctgtgatgatgaaatctgcaactttgttcttcatcagattcatagggatcgctgaaaactgctgggatgctccaccctgaaggaataatactttgtaattatcagggatgttcattaattctcttaagtctgcttctgcagttttgatgatatcatcaaacatcttggatctgtggctcatctccataacagacattccacatcctctgtaatcaagcatttcctctgctgcttcttttaacacttcttccggaagtactgccggtccagctgaaaagttgtatactcttgccatttcttttctctcctttatatgaaaataaattaaaaattaccttgcctgcgcctcaagatccgatttatcaaatgcatcttcaatagaacctcctggattaaccatcggccatactttgtcatctaaatcaatatgacaatcgagaactactggttctcctgcatttaaagcttctttgaatgcatctttgaattgttcgatatccgtgatcttcttagcttgcaccccaagtccttctgcaactttcacaaagtctactttgtcctgaagtgttgtatacgaatatctttcttcataaaacagatcttgccactgtcttaccattcctaacacgctgttattgataataacttcgatcactggaatgttgtatcgcgaggctgtcgcaagctcatttaaattcatacggaaacatccatctcctgcaatgtttactacgatcttatctggattaccaactttggctccaaggctggctccaagaccgtatcccattgttccaagaccaccagatgtcaagaatttacgtggtttatcatatttataaaactgagcggcccacatctgatgctgtccaacttccgttgtaatgactgcctcaccttttgtaatatcataaatcgcttccatgatctcaggacatgttaatcgtcctttatcataagttaatggatacttttctttatattctttgaccgtatcaagccactctttgtgttcctgggcttctaaacggcgattgatcactgttaatactgcttttacatctccgatgatagaagctgatacacaaatattcttgttgatctcgactgggtcaacatcaatctgtaaaatctttgcattctttgcaaatgtttttggatttcctaaaactcggtcactaaatcttgttccgactgcgatcagaaggtcacagtgagatactccaagatttgatgcttttgttccgtgcattccaagcattccactatagcgttcatccgtaccattaaatgctccttttcccatgagggtatcgcatactggtgcatctactttctctgcaaattcttttaattcatctgctgcatcagagatcacagctccaccaccaactaagatatatggtcgttttgcttctctgatcatgctgatcgcattctggatatctacttctttgatatattcactggaacgtatgatcttcgctggtttgtatttttcatatagggtcgttgctgctgtcacatcttttggaatatcgatcaaaacaggccctggtcttcctgtctttgcaattctaaacgctcttcggatcgtgtctgcaagttcttctatattctttacaataaagttatgctttgtgatcggaattgtgactccggaaatatcaacttcctggaagctgtcctttccaagaaggctgactcctacgttacatgtgatcgcaacaactggcactgaatccatattcgctgttgcaagtcctgtaacgatatttgtcgctcccggtccactggttgcaaagcacactccaacttttcctgtagatcttgcatatccatctgctgcatgagaagctccctgctcatgagatgtcaggatatgtgtaaaatcctttttctgtttatataattcatcataaatgtttaagatcgctccgcctggatacccaaaaacggtatccacgccttgctctttcaaacattctaaaacaatctgagcacctgtcaattgtttcatcatttgatcctcttttcttacttaattactgtttgatttctaaaactgctccgcggtttccagatgtaactaacgatgcatatcttgcaagataacctgttgtaaccttaggtgttctaggtttccagttttcttttctctttgctaattcttcgtcagaaacttttacatttaatgtattggcatcgatatcaattgcaataatatctccttcttctactaatgcaatcggtcctccaactgctgcttctggagaaacatgtccgatacaagctcctctggaagctccggagaatcttccatctgtgatcagggctacgcttgatccaagtcccatacccatgatcgctgatgtaggatttaacatctctctcatacctggtccaccttttggtccttcatagcggatcactacgacgtcccctggtttaatatctccacctttgatcgccttgatcgcatcttcttcacaatcaaagactctggctggtccttccatcttaagcatctcaggagcaactgcagaacgttttacaacacctgaatctggtgctaaatttccttttaatacagcaattccaccagtctggctgtatggatcgtcaatcggacgaataacttctggattcttgtttacgcatccttcaatgttctctgctactgtcttacctgttgcagtgataagatctgtatgaagaagattcttcttatttaattcattcataacagcataaactccaccagcttcatttaactcttcaatatatgtatgtcctgctggtgcaagatgacataagtttggagttctcttactgatctcatttgccttctcaagattcagatcaacacctgcttcatgtgcgattgctggtaaatgaagcatactgtttgtactgcatccaagtgccatatcaactgttaaggcattctcaaacgctttctctgttaagatatctcttgggcggatattcttctctaataattccataaccttcatacctgcatgttttgcaagacggattctttcagaatatacagctggaattgttccatttccctgtaatcccataccaagaacttctgttaaacagttcatagagttcgctgtgtacataccggaacatgatccacatgtaggacatgttttgttttcaaattcatctaattcttcttttgtgatcttacctgctgcataagatccaacagcctcaaacatgcttgataagcttgttttacatccttttacacgtccggcaagcattggtccgccactgacgaacactgtgggtacattaacacgtgcagcggccattaatagtcctggtacattcttatcgcagtttggaaccataactaaagcatcaaactgatgtgctaatgccatacattctgtagaatcagcgatcagatctcttgtcaccagtgaatatttcattccaacatgtcccatggcaattccatcacatactgcgatcgctgggaatacaactggtgttccacctgccatagcaactccaagttttactgcatctacgatcttgtcaatattcatatgccctggcacgatctcattatacgaacttacgattccgaccaatggctttctcatctcttcttttgtgaaacctaatgcgttaaataacgatctttgaggtgcaaatgcttctccctctgtaaatgtattactcataaaactaacctcctagtataatatatctcattctatctatggtgagcatcgaattcttatttgatctgatcaatgatcagctgtcccatttctttacatccgactttcttcattccatctgacataatgtcaactgttctgtatccatctgctaaaactgctttgactgctttttcgatctcatctgcttctttatctaaatcaaatgaataacgaagcatcatagctgcggaaagaattgttgcgattgggtttgcaatatcctgtcctgcgatatccggagctgatccgtggcttggctcatataatccaaacttaccttctgcaagacttgcggatgataacattccaatagaacctgtgatcatacttgcttcatctgataaaatatctccaaacatattctctgttaagatcacatcaaactgacgtggattattaactaactgcattgcacagttatcaactaacatatgttcatatgtaacatcttcgtagtccttggctacttcttctacaactgttctccataatctggaagaatcaagtacatttgccttatcaacactgatcacatgttttttacgttttcttgcaatgtcaaatgctttgatcgcaattcttctgatttcattttcattgtaagataatgtatcaacggctgttcttacaccatcaatttcttctgtatgtctttctccaaagtaaagaccacctgttaattctctcatgatgaccatatcaaatccatcaccgatcacttcatcacgaagtgggcatgctttctttaattcatcatataagtatgctggtctgatgttagcaaataatccaagagatttacgaagttttaataagcctgcctcaggtcttaactgtgctggaagtttataccatggagatgtacttgtatttccaccgatcgaacccattaatactgcatcactcttcttagcaatctctaaagcttcctctgttaatggttctccatgaacatcaatggatgctccacccatcagtatctgtgtataagaaaatgtatgtccatacttttctcctacagcatctaaaactctcattgcttctgtgacgatctctggcccgatcccgtcacctttaatgactgctaaattacaattcatatcttcttcctcatttcttcttgatattacttatgtctgtcaatgaattggcagattaatttaccctaaaactactaatgcgataaatgctccgatacagcttgcacatgcaactgtaacaatattttttttattatatgcaaaaatcatcgcaattgcaaatccaattgtcgatgcgatcaaatttcctgtcgcataaaacactgctggcatgatcattgctgccagtactgcatatggaacatagtataaaaatgatcgaaaaaatctattctctatcttcttctgtattgcaaccaatgggatgactcgtattagatatgtagaaactgctgtgactgcaatataaactaataatctgctaagattcatgagtctcctcctcttctactgggaataaaattgctccaaatgttgctgcgatcaaggtacaaatgatgatcacgaacccactggatataaaagataacgctttgatatatttaaataataaactaacgatcatggaaagaatgatcacgatagttatatgcttatcttgtctggctggtgggatgataatcccaatcaacattccataaattgcaagtccaagtgcattccttaagatcaatggtaataatgtattggccgtcgctcctaaaagagttccagtggtccagctgatccatggaattgacatcaaagcataaaaatatctgggcgtaatctcatgtctccccgcacaggatactgcaaaaatctcatccgttaccataaatgccattgagatccgattccacaatgtcgacttctcacttaatttctgtccgatcgcaattgacatgatcgaatatcttaaattaataatgatctgtgataaaactaattccaccaaagatcctcctgccgtcattgttatgatcgctgcaaactgtcctgcagaagttacacaggttgctgagatcaaagtaagtgcccatacaggaattcccttagacgctcctgaaattccaaatgcaaacgaaacagccacatatgctagtccgattggaattccatcaattaatcctcttcgaaattcattgtctgatttcattatctgctcctatagttcaaaataattcgattcctgtaaaaatatagaaaatttcccccaaaaatcgagcttatatattagaataccacattcttagacagattggaaactatttttcattttataaaagaattcttttcaacttttcagaaatttcacaacattctaacctaatctcgcagaaaatatgttctcgttgaaaaactacacaaaacatattataatgacactaacgatcgacaatgaatatgaggggtattatatatgaacaaaaaacaaattttatgtactggattatctcttgcacttcttctatcaagtgtaataaccacaccagcttctatagctgcagggaaatattttaagattcagtacatacattctaagaaaaaagtcaaaaagaaagccatcaatgccagatataataataaggttataagtacaaaaattccaggatatattgaaggttctacttctatgtattctgcatactggatcttcggtcactgttcttctcttggaacaaaatattcatattcaagttccaaaaaaagagttacattacaacgaaattctcagaaacttgtgatgactttaaacagcagaacagctaccttgaatgggaagaaattcacccttccatctgcacctcgaaaaatccgttatatcgcaaaaaagaaaaattatatcatggttcccggagatatcgttgcaaaaaaactaggcttaaattattcatggaacaatcgtctgttatcaggagtgatctcaaagggcagtactaataaacctgctccttccactccatcaaatacaaaacctcagacttccaatccttctggaagtacaacaaagatcaccgcgtctgaatctgattattcaatccgaatcaaaaaacctgatggtctttcatcatcttctataagctccaacgatgattactggaataagcagttacagatcatcattgacggagattaccgcaacttttttaacacagcttctaaccgcacgatcaaggattctttaacttataaagtttcttatctaaatggaaaaacttatatcaatctgataacatcagcgatcaaaggattctctgttactcagacagattcttatatctatgtcaagtatgcggcaccaaaggatatgttctacagagtcattgttattgatgccggacatggtggaaaagacagcggcgcaactggaaacggttatatcgaaaagaacatgaccttaaagatcgttcagaatatcaagacaaactttgactctgatccgctgtataaggtttattacaccagactctctgattggtatcctactcttaccgaacgttatgatctggctaacgccgtcaatgctgaccgttttttaagtgtacatatcaattctgcagactctgccagtgcaaaaggaactgaaacattatataaggattataaaacatatgccagtgtcattcattcctcttcgctaagcggaatggggtatacaaaagggtcttcttatgaccgaagccttgtataccgtcctggacttgcagtacttcgaggaacaaaaatgatgagtgcccttgccgagatgggattcatctctaacagcacggaatctgcaagaattgacgctagatctgaggcgatcggatctgctctttaccagtcactctgtaattcttttaattaattttatctaataatatcagactgtatctcaggaaatccaaagagatacagtctttttattgcattaatattacaaatatgttacgatttaatctatgagaaagggagataaacaatgagattacaaaagttatttattacaacactattatcagtttcagtcattggtacggcaatacctgcaaatgtatctgccgcatcctatgcaacgacaaaacgcacatacactttaaaagttgctggtaaaaagcagaaaaagaaagctcgcggtgcaatctataatggtaagacgatcaaaacaaaagcacctggcttcttacgtggtgatacaaccatgtattccgcaagctatgtattccagaagggattaggcgtttcttattcttactcttctaaaacatggaagatcactttaaaaaaaggttctaagacgatcaccatgaaacgtggcagcaaatatgcttatgtcaatggaaagaaaaagaaacttccaacacctgcacgccgtgtatattcctataaacagaaaaaaaattacatctatgttcctggtgagttctgtgcaaaacatcttggatattcttattcatggagcagtagttcttatgctggtactttctcaacaagtaacagtaataaggcatcttcttccgttacaacgcttccagcaacaaacggagaacattatgtacaacttgataaaccagagggcttatccgaaagcaacatctcaacaactgacgattacaataactatcgtctgatcgtaaacattaaaggaaattattcttcttattattccgatgcgtcacatcgcagtgttgttggtgattcaagcttctattcttattctgtagcttacagcaatggctatacaaagatatatatcaagcctcgaaaagctacgatcaaaggattcgaagtaacacagacagattcttatatcaaggttcgctatgattcaccaaaggcaatgtacaaacagatcgttgtacttgatgcaggacatggtggttcagactctggagcagttgccaatggatataaagaaaaaaacatgacattaaagatcgttcaggctgcaaaatcatactttgataaagatccagatatcaaagtttactatacaagattatctgacacatacccaagccttactgaacgttctgatcttgccaatgaagttgatgcagacagattctacagtgttcatatcaactctgccggatcttctgctacaggaactgaaaccttatataattccaaaggatataaatcttctacaggactgacaagctatagttggtcagcaaccattcatccttatatccgttctgctacaggatttacaaaccgaggtcttgtaaaccgtacaggattagctgttcttcgtcatacaaagacatcttctaccttaactgagattggattcatctctaacaaatctgaagcaaaggaaatgaactctaatcttacaaactatggaaaagctgtctataacagcacaaaagcatcttttagcaaaaacccaactgggcgataatattgtattaaagtatttatattcataactggcagtcatacatcaaccgtatgactgccagttgcttatttataatatggaatcaccagatacatgtcttccgtaatctttccatcgtatatatgatttgtctgacatacctcttcaatataatcgtcaacagacgaatattcattccccatatatttctttgcgatcttccataatgtatcacctttctgcacctgaatgctggtaaactgcttgtcttttgttccctgggcctcgatcaggttgttacttaaaaggaaagcactcattagaaaaacaaaaactactgctatgataattccgatcactcttctcttacttctcataatatcatcctccgcaaactataatcgaacatttgttttgtttatgtctgtattatagttctcgaacatttgtttgtcaagcttttcccgaaactttgttcgagaacacttgtttccattttgaatctatgttatgataagaatagtttataaacagacacggaggatatgatacatggccaaagaacaattaagtgacaaacaacaacagatccttgaattcatcaagcgacgcattctggataaaggttatccacctgccgtacgcgagatctgcgaggcagtgaatcttcgttctacttcctctgtccattcccatctagagactttggagagaaaaggatacattcatagagatcctaccaagcctcgtgcgatcgagatcaccgatgatgattttaatctggctcgccgcgagatcatcaatatccctgtcgtaggtaccgtcactgccggtgaaccgatcttagcggtagagaatattgaagaatattttccaatgcttccaaatcatatcagcaataagaatactttcatgctccatgtccgtggagaaagtatgatcaatgccggaatttttgacggtgatatggttattgtcgaacaacagccaactgctgataatggtgatattgtcgttgcaatgatcgaagattctgcaactgttaagagattttataaagaagatggatattacagactccagccagagaatgatactatggatccgatcatcgtatcagaagtatctattattggtaaagtcgttggactttatcgttcaatgaaataaaaagaagtcagctgcgagatgctttcaaagcattcccatagctgactttttttcatatgattctttttaatttaattcttcgatcgatacttcttttccgtctttccagattctttcaagatcatagaataaacggttttctttatcaaagatatggatgatgatatcaccaaagtcaagtaagatccagtttccttctctatacccttccatctgtttcatctcatatccagctttaaaaagttcttcctgtacattatctaccattgcctgtacctggtttttgttattaccatctgcaatgataaagtaatctgcaagaacagaaatgcttcgaatatcaatgatcttgatatcttctgctaacttgtcatctaacgcatcatatgcgatctttaccatatttaatgactgatccatcttaattctcctttttgtctctataatacttataagtctctactgtccgctcatcaatttcctgtccacattctgtcaggtactctatcgtattcttaagaattgtttttgtacatttatcaagatcctcaaatgccagcttacggacttttgaaagtcctggaatcatctttcgatttggttccatatagtcagcaataaaaactatctgttcaagcggtgtcataccgatcttccctgtcgtatgacatgcgattgctgacaaaacttccgaatcctgttccttatattcatcgcttgcaagaaatggagcgatctcttgatgcatcagctgcggacttttggttaaagttccctccagactgatattatatcgtttgcataacgctctttgctcctccattgaaaagcctttggcacaatcatgtaaaagacctgcgcgatatgctttatgaacatccactccaaacaccattgccatacaggaagctgtataagctactcctagtgtatgccggtatctggatggttttaacgctgttttaagcttttcttctatctgctgtacttccatataaatcatttctttctatataatcaatcacatcttctggaaggaagaaatgaatacttgatccattgctacatctttttctgatatcattggatgaaatctcaatgcttggactgcttaaatgataaatcttgccatcgtatttctcttccagataatcaatctgagcatccagagcacttcttgagtcatttcttgtagctactaatatatctgccatggtaaaaatctgtcctggatctttccatgtctcgatctgataaagcgaatctgctcccatgatgaagtaatatctgcaatctgtatcctgttttgtaagttctcttaacgtatcaactgtgtacgttgttccttcacgttttaattcgatatcactaaatttgaaatacggaaaatccctgatcgccagcttgatcatatcgactctgtttttctcactgacaccgccactgatctttttatatgccggattctttgttggcataaccaaaatctcatccaatccaaactcttctttcgctgcctgtccaagaatcagatgtccatgatggatcggattgaatgtcccgccaagaattcctatcttcttcatggctgtcctccgatattatttccctgcttttggcagttcaattctcttatgattctttgattccttatataatacgatcttcttaccaataacctgtacaacctgggatcttgttctctctgcaagaacatttgccagttcttttggatcgtccatacagttttgaagaacaccgatcttgatcaattcccttgcttctaaagcatctctgacaccctgtacaagttctggtgaaatacttccttttccaatgttatagatcggatcgatcttcattgcaaggctctttaaataagctctttgtttgcttgtcatgttatcctccattcaattatatctatctatagtagtcaaactccagattatacaaacgtacggtgtctccttcttcgattcccatttctgttaaacgttcaatgacaccgttttctttcatgaatttctggaagaagtcaaatccacgctcagattccagattagtatatccaagcattctctctactttcggtccttcgacggtatataatccttcttctggatgaccgataaagattccaccttcttcttctccgaagtttaattcgtattcctgttcaaattctgttgcaccttctggtaattcatctaataatccctgtacatgccataataattctttaacaccttccccgcttaccgcagaaatagggaatactttgattccttctggttcaaactcttcttttaataaatcgatcacagtctctctgtctgtctcagacatagcatccatcttgttcgctgcgatcacctgtggtttctctagaatctctttgttgtatttcttaagttcatctgtgatagcatggatatcaacgatcggatctcttccttctactgaagctccatctaccatatggatcataacttttgtacgttcgatatgacgtaaaaattcaaatccaaggccaacaccttcagacgccccctcaatgattcctgggatatctgcaatgacaaatcctttgcttccatccatatccacaactccaagatttggatttaatgttgtgaaatgatagtttgcgatctttggatttgcgtttgttactcttgataaaaatgtagattttcctacatttgggaatccaaccaaacctacatcagcaataacttttaactcaagcataacttcgagttcctgcgctttcccacctggctgggcatattttggtgcctgcatggttggagttgcataatgctggtttcctttaccaccacgaccgccttttaaaagtacaactggttccttcttattagacatatcaaggataactttccctgattccttgtcttttacaacggttcctgccggaactttcaggatgatgtcttctccatcagcaccgtggcattttcttctgccaccttcctgaccatctcctgccttgaattttcttctgtgacggtaatcagataaagtattgattccttcatctacaacaaagatcacatcaccgccacggccgccgtctccaccatctggtccaccgtttggtacataaagttccctccggaaacttacgtggccatctccaccttttccggatctgattataatattagctctatctgcaaacattgtcttttcctttctgtgtcaaaaaaacaacttccagtcataaaaaagtgtcttcgacacttcaactcccctgcccctcattcttgaggggtgggtttctttttttgtctttttccttcataatagaatcatgaatatcctacaagagatctttacagatcattatgaagaaatcaaatatactcttcatcccagacctgctgagatggaaaatatcgataagatgatcaactgtggtgatccttcttatggtggtgccatgtatggctgtatccactgcggaaatctcaagtttgttcctttccgttgtcacagccgtttctgccctacctgcggtaataaatattccatggatcgcactacctctatgtcctttaagctcgttaatgtcagacaccgtcattgcgtttttaccattgatgcgtccctccgtgattttttcctgcaggatcgctctctccttaactgtctctttcattccgtctccagtgttgtccttcgcttattctctaaaatgaacaaacacaaaaactttacccctggttttatcatggtcctgcatactttcggcagggatcttaaatggaatcctcatatccattgtctcatctctgaaggcggttacagtgatgatgctttctggcgtaatgtctctcatttcaactatactttccttcgcaatgctttccgtactgctctcctcaaggaaatgttgctccgcatcggtccttcttttaaaaaagtttctgcccgttgttatctggaacatgaacacggcttctatgtttatgccaaacccaaccgttgtgaccctaagactgttaccaaatatattggccggtatcttggtcgccctgtcattgccacttccagggtcgattcttataccggtgatcttgtctctttccattacaatcgtcacgaagatgatcaatacgttcaagaaaccattcctgtcatggattttatcaaacgccttatccggcacatccctgaaaaacatttcaagatgatccgttatggcggcctttatgccagacatcgttccattgataaaaaactccatctcgctatttcgaaagaaaaacggcatactttccgttgttttaaccggtggcgtactgcgatcctttcttcttttggctatgatcctctgatctgtcctcattgtaaacaacagatggtgatcctagaaatatatcataaccatcgccgcgtacctcttgaagaattatacgagaaagcaatgtcccgctcccgtggaaagcgttcttctgcatgaccacttctttttatgctataatcctcatataaaggaggaaccctaccatgaaaaagaatatcaaagagctacgcgaaaaatatatttcaaatcccccaaaaggtatgacatccgaggacattcgccatatgagcgaggatgacctgctggatatggattattttctaaatgaagatgtgtttagtgatgattttggtgaagaaggtttttatattttctaaaaccatgatcatctgtttgctctgcccacttttatgtgggctatttttcttttggaaaggagccaaaggcgaactttcctataaagcaaaaatatttcattatcttataatgaaaaacggcctcaaatatgtatttgaagccgtaattactgaatctcaaatgatctgttcctgtatgcaattaaattatgctactggatgtacagaacactgtttcttatctttaccttttctttcgaagcgaacaataccatcaactaatgcgaataatgtatcgtcaccaccgcgtcctacgttaacgcctggatgaatctttgttcctctctgtctgtaaagaatatttccagcttttacaaactgtccgtcagctcttttcgcacctaatctcttagattcggaatctctaccgttctttgtagaacccattccttttttatgagcgaaaaattgaaggttcattttcatcatttttgttacacctccttaaagattacatctaaatactgtccatgttcttcttctactgaagtcagaccaaggatcagtgatcttaataacaagctcccctcttcggaaagctcttccgtaaatactacgtcaatttctgcgtcttcctggttcacatcaatctgatagtgatcatctgtcagttcatccagagaattcacaaaattaattaccagagcagacactgcggcacagacaatatcttgtccttccgcactgtaacctgcatggtcctgtgagtggaaaccttgaaaggttccatcgactctctgatagaatgttatctttgtcataactctatcctcaggatattatccaacgatactatcgatcttaacctgtgtaaataactgtctatgaccgtttttcttatggtatccagtttttctcttgtatttgtaaacgatgactttcttaccttttccttcgcttactacagaagcttcaactttcgcaccatcaacggtaggtgttccaactttaacagtatctccaccaactaaaagtacattatcaaatgttactttagctcctacttcagcgtcaagtttctcaactttgatcacgtcgccttcgcttactttatactgttttccacctgttgcgataattgcgtacatcacggcacctcctattatcaaatctcgccagctttggtgattctcgcattctttaacctcgctgtgcggcatactcatatataataacagcactatttcaatatgtcaatacttatttgtcgaaaaattggatttttttctttttttcttgtaatctccataattccgagctttgtaatatctacagcaactgctttcttagaatccccatttagataatgctgcattacctgtaataattctttctcatcatctttggacttcatatcaataaaatcaatcatgatgatccctgataaatttcttaagcggatctgccttgctgcttctttggctgcttctaagtttattttcttaatatgtgcttcctggttcttctttccaatggatttccccgtattcacatcaatgactgccattgcctctgtctgttcgatatacagaaatcctccagacttcataaatattttacgtttaaatacctctgaaagataatgacgaaaccgatatcttcgttcaatgtctcctgccatataagaacataagaatacttcataacctttttctttcagctgttcccctacttcttcctgatctgtcacaatacgattgatcgatcctggtttgatattatgaaccagcacttccaatgcatcgtaatttgtatcaacaagatgaggagctttgcggtattgccttttagatacgatctcatgatatttcgcagacaactgatctgcttccataagaacatcttctttgtcggcttttgcagcttctgtacggagaataaagccatattcctgtgtcacaagaggctctgccatttcttttaattcctgttttttttctttctgatgaatcttattggaaattcctacagacagcttatctgaagtcagcacaagatattcccctgttaattctatctgatctgatagcatcggacgtttttcttctgtcgcttctttctttatctgtaccaacacttcatcacccgctttatattgcctatgtctcatggaaaggaagcctatttcgtcttgatcgaactcaacaaaagccccattgatattcttgacaacattttttacgactcctatgtaaatattcccaatatcaactttattcttctcacttacacattgaaattctaccggatgaccatcttttaataacatactgaccagatgatcgccaaaccttgtgatcacaatctctgtatatgccattattctttgatacttggaatttctacaacaggatctgtttctgcttcgtagtcgattccttcctctttaaatccaaacatacggtaaaaatcttcccaataaccatcaacatctgcaagttctgaaacattatctgtattaatctcttcccaacgtttcttcacttcatcctgaatatcatcacgaagttccagatcatccatacgaacccatccgtgttcatccgtgatcgtatcggctaataatctcttttctttaaacagacgttcaatctgttcaatacatccttcatggacattattttccttcatgactttatataatacagacatatacaatggaacaataggaatcgcagcacttgcctgtgttaccaatcctttgttaacagagatcagcgcttttactccaacttctttcgtaatctcatctgctgtctgatgcagatgtttctttgccgcaccgatcgttccttcaaaatagattggatacgtaagttcagatccgatataagaatatgcgacagtacttgcatcttctgataacacatctgcatcttttaatgcctgcatccataacttccagtcttctccacccataactttgactgtagcctctacttcctcttctgtagctgcaggaatgctcttcataccaatactgttatccttaaggttcagattcttatttgtaaactcctcccctgttgtctttaatacagaacgatatgtcactccatctggtgttgttcttcgtggtgctgcaaggctgtatacaaccagatccactttcccaagatctttcttgatcgtttcgatcgtaagatttttgatttcttttgagaacgcgtctccattgatcgtcttggcataaactccttcttcgtttgcaaactgttcaaatgaagctgtattataccatccaggacttgctgtctttcttccattagatggacgttcaaacatgattccaagggtatctgcatgacatccaaaagctgccacgattcttgatgccagtccatatcctgtagaacatccgatcactaacactttcttcgcatctccaggaatctctccttgagcttttacataggcgatctgatcttccacattctttttacatccttctggatgtgctgttaagcataaataatctttgactctcggtttaatgatcataaatttttctcctttaaaaacatctgcatcctatacaggtgtattgtttattatcaacttattccttcaaattataatatgtatcggatttatctgtcaaatttttataatacactttttcaaattttgttggttatcttgggaagttttcaaaactttattctcagcatcaaaagaagaaggtatttctttttctaaaaaataccttcttcttatcctctttatttaacgattcttcgtactgttacgattcttctgtatcttgcattgtttgaaatcttaattccacctcttggatatggtgctgaattacttgcatgtacgatcttgttgtttcccatatagattgcaacatgtccgctatagcagattaaatctcctgccttagcattcttgatcccaccttttactttcttaccatatcttctctgtgcacttgaggaatgtggaagacgctttccaaacttcttgtaaactcctctcgtgaatcctgaacaatctgttccgtttgtaagacttgatccaccgtatctgtatctattccctacaaagttttttgcatattcaacaactgcatctcctttttctgatgcttttacttcttttgaacttgtatgtacactcattgtaactgcggccgatgccattgctactaacatcatcactcttaaaataactcgtttcatattaactcctgatatattacaattttaaatttatttcaaatatttctttcaacagttgatattgtacgataaagagcaataattgtcaatagttttttaagattatttcggtttagttaatatttttgtaacatttctgttttttctctttaataaatcaagatgtcgttttacaagatttagttcatgtctggtaatatccttgttactgtaccttgctttctctatgatctctgacgtcatggaattgctgttattccttgattttgcgccattttcagcatatttttctaactgtttttcataaaaaagtactttttctttatttgtcatttgattccattttcttttcttttgtaacaattttatgaacgcaaaaatcactgctaatattatgacgattggaatcatttgaaacattttctttacatttgttacgaattgttttttatttggtacaatcgcatttcgttgtttttcttcctgttccacatgtttatatacactttctccagtatctcttcccgttacttctaccggaatccatccgatatgttcaatataaatttctgtccatgcatgtgcctcataatctgtcacctgtgcttttccaagtctccactgatctgcacggatcttatatccttctacatatctggccggaattcctgcttccctgaacaaaaaaactgccgctgatgcaaactgggtacaaaaccctctttttctctccgttaaaaattcatttaccggatccttatcttgccctgttaaacctggtcggtaagtatattgataattattttttaaaaatttttgaatttcttctatattatataagatactattttctttatttacatggcaactcagctgctttattgtcttctttatctcttctggaatctccagataattctgctgtacataagttccatactcctgcatagaacgaacataattcttttcaagctctcccgcatttttcaacacagacatcacgtcaaatctctgactgatatctaacaggttcttgttattcttgatctgataataagaagttgtatactccgtatctgctgtattacgttctatcacactgtctccagctgcatttccattaattctgctcgcatctgaaaaatatggtattaataagaaactctcctgcatcttctgataatgaatctttatttctctcttttcagaaaatgcaatatcttttggtgtctgaatatatcctttctgataaacagcaaaatccttcatagagagatctggaaataaatatggcagttcctgtgccatttctccaccgtagaccaggttatttttcttttcctttgtccattctccatctttatatctgccactaacaaatcccttcagatacagatctgcattttccagggcatacaccagaaataatttttctccttttggagaaacttctcctacacttcgaagctttccattcccgattcctccgactgcaagatagccttttccctgtgtccattccctgatctgtatcagaatatttcgttttatcatcgtatctgtaggtacattcgtctgatcataaaaaaacaaaggtactgcggcagccagaaacataatatacaatcctgccgcaaatcctttttttccttttcgtatactaaaataaacaatccatgaacctaaaaacaagaaaaacgctgctgaaattccatatggcgcgatcattaaaacggccatttccataagaccggttgtaagaaacaaagtcaatggacgacatcttaatattccaagcacaattcctgccaccagcacaaaaaacaaaactgccagtacgctgtcccttcgactatgttctaacgtcaccgaaatgtaataataaaatccaagatccatactctgattcaatgcttctgccatcttattattgatgatctgaaatccattgatcagctgtctgtgtgcaagcatgcagtatatgatacatatcacaaccatgactacaatatttctcttattctgatcaagcaatctacacattccgagaaaccaaatgacacttcccatcacaaaaagccactgaaaccttgaaatccgaaatccagcaaatatactccatacaacagatgcaaaagccactgccatcatgatatattcaatttttatttttttatatccacacattataactccatatcatataaaaatttctgcagatcttgtcctttttcacaaagtggaatcttataaagatgctccatcgaatccgatgacaattcatattttccacaaaaaatatccgtaaacaattcttcatattgttctatatggcaaagcagatatttatgctccccataatagatttcctgtataactccctgcgatttcaaaaagaaagaaatagaataaaaagctgccatataatcagaaatacggtctttttctatatcatccaacgataatccgatcttcacgcgttcttcttcctcttcttcattttttctcacccaaagtccacctgtcgcagcatagaggttccaatgaactcttgaaatccgatctccttcctgatatttcctgactccatcgtattcaaaaccttgttccataagatctcttcttgcgatcttttcctgcatagatcccatttcatatcgttttggcataacaagaaaagatatttgtttgttaaattctttttttactttatacattcctgtaagatcttcccacgaaactgaacaaatctgaatatgataactgtcacattccgtgatcatttcagacagtgtgatcgaatctccttcttgtggattccatacgatatttttcttctttcgcattctttgttttcgaaacttggatgtcatttcatattccaatcggaatgtatagctgtttatctttgatgtaattccatgaatcctcaatcgtatctctgcttcatcgccttctgtaagtactaatgaatccatttctatggttaatatcatctgtttttgttctgactgacacctgcagacagaataagccagcacaacaaataaggatgccataaggcaccctccaatgaaatttccataaatgatccaatatataagcgcaaatattatgacaaaaaaatacatctttatcctttctgatttccttttggaagtggtatcttataaagaatcgcttttaaaatctcttctttcgttttcctctgaaccttcgcttccttgcttctgatcaccctatgctcgatagtttcaaagaaaacatctttcacatcctgtggtattacataatcacgtccctcaagatatgcatttgcttttgccatcgataaaagtgcgatcgttcctcttggactgattccaagttctaagtctctggatcttcttgtctcattcgcaatctcgacaatatatcttaaaatatcttcatgcacaaataatcgtgcagcttcttctcttgcttttcgcaattcttccaccgagatctgttcttcgatcccagaggtcgtcatatccacacttccttgtgctaacatcttgatctcactctccatatccggatatccaagagatgtccggatcataaatcggtctaactgtgattctggaagcgagtgtgttccaatagaaccaaaaggattctgcgttgcaataacgatatacggatctggaagatctctcgtaataccatctaccgtgatctgtccttcttccattgcttctagaagtgccgactgtgtcttcggtgaggttcggttaatctcatccgccagcaaaagattcgtcatcgctgctccttctttgaattcaaattcttcactaccctgatgatagatagaaaatcctgcaatatccgttggcatgatatccggagtaaactgaatcctttgataatccagtcccaatacctttgaaaaggctaatgcaagtgttgtctttcctacacctggaatatcctcgatcaagatatgtcctcctgcaaggatcgctgtcatgatctgatgcaccgtatgaccttttccttccataacacggttgatctcatccattgctctgactgcttttttgtacataaagaaattatccatcttatcttcctcgttttgcagttataacaatgatcatcatagcaagtgcaaggcttattgctgctcctgcaagtccaatatatccatttcctgtaattcctgacaaaatatatccaacacttgcacaaagtgccactgttaatgcatatggcatctgtgttgccacgtggtctatgtgcttacactgcgctcccgcagatgaaaggatcgtcgtatcagaaatcggtgaaatatgatctccacaaacagctcctgcaagaatcgctcctacacaaactgacatcatcatataattagcacttaagatcgtaacagaaattggaatcaaaattccaaatgttccccatgatgttcctgttgcaaatgcaagtcctaatgaaatcaggaagaagataaccggcatcactgcgattgccattgtacttccaccaacagctgctttaacaaatccctgaatatttaaatactctgctccacaaacacctgataatgtccatgcaagacaaaggatcatgatcgctgatgtcattgctttaaatccctgtgcaaagcttccacagaaatctacaaattcaagaacttttcttggaatatacaaaataaatgtaaagatcaatgttaaaaatgatcctaataccaaacttctcgcactggagcaattagcaaaggcctctgcaagcggaacccctttgaaaaagcctcctgtgtacaacataaatccaatacaagaagcgatcaaaaataaaatcggcaagatcagatcttttacctttccatgtccaacgatcggtacttcttcttcgtcttcaacgatctcttctaaatgtgcatttaattcatattgtttcatctttgaataatcaatattcgtaatgatcaaaaatgccaaaaatacaagtgtgagcaatgcataatagttaaatggaatcgctctcaaaaataaggtaaatccatcaatattgcatcctgctggaagagatgatcctacagctgctgcccagcttgagattggcgcaataatacatacgggagctgcagttgcatcgatcacataagccaattttgctcttgtaacattatgtttatctgtcacagggcgcataaccgttccaactgtcagacagttaaaataatcatcaacaaagatcacaactccaagacagatcgttgcaaaaagtgcctgtctctttgtgcggatcgcttttgctgcccattttccataggctctagaagcacctgatttggtgatcagtgctaccagaattcctaataatactaaaaatatcaaaatatcgcaattagctccaattttctctcccatgatcgcaaaaatggtatccattgctttgatcagatgaaaattatgatacatcagggcccccgatgcaattccgatcatcagcgataaatatacctccttggttattaatgctaaaacaattgcaatcactggcggaagaatcgcccaaaatgtacctgtcatgtatatttactccttaatctttaatctctgtaataattgatgaggcatccttttaagatgatctctctctcatcatctgttaattcacctagtgttaatgtgatctctttcattccttcatttaccacatatgctggaatctttgtaagcttgtcttccactgctttgcggacatctggaacaaaaatgtaatctttgttcttaaatggaagttctcctttatcgatcgtaaatggaagcattccccagttgatcaggtttgaacggtatctctttgtcgcatattcatttgcgatatttgcccatccacctaatactttctggcaagaagccgcctgttcacgtgcagaaccatctcctggtttcactgcaaagatcgtgcttccgattcctaaattatcctgagttacatccgcgtaagattctttgactgtctccaggatatctttaacttctgggaatgcttccgctgcatcttctccagcttcgatcgctttctgtgctttctgtacttcttttgcaagtcctacatatgcagggtcttttcttgataacgcaaattctgcaagtcctaatggattagaacgataagatgaagtttctccagatggaatcaattcatctgttgttgtaacaggatcatgaatctctgatacaacttttaataacatgttctgtggaagtgcagacatctctggccaatctttgatgtttggtccaaactgaatctctactgatggatctgcaacacccttgctgtcaaatacacgattatcataaattgtcttgtcaaagtgatattttggaataaaatcacttgcttctacatccgttgccggtgttaaatatcctttattcgctgctgttgctgcgatagaacgtgcatccattaatgcaacggaagaaatctggccattctgaagtttagaaccttcacggttcgggaagtttcttgttgaatgacgaatactaaacgcattatttgcaggtgtatctccagcaccaaaacatggtccacagaatgctgtcttaacgatcgcacctgtctgcatcagatctgcaactgctccattcttcacaagttccatataaattggtgtacttgcaggatatacgcttaatgtaaattcatcagaaccaatacttgctccttttaagatattagccgctgcacagatattttcatatccaccacctgcacatcctgcaatgattccctgatctacataaagttttccatcgtggactttatctcttaaagaatagtcaactgcaccatctaaacttactaatgcacgtttttctacatctgcaagaatatcgtcaaggtttgcattcacctcttcgatcgtgtatgtattacttggatggaatggcatagcgatcattggtttgatcttatctaaatctacttccacgattccatcataatatgctacttttccaggattcaattccttaaagtcttcagaccttccatgaatctcgtaaaattccttgatcttatcatctgttctccagatagaagacagacaagttgtctctgttgtcataacatcgacaccgattctgaaatctgcacttaaattagatacaccaggtccaacaaattccataactttattgtttacatagcctttttcaaagactgctccgatgatcgccagtgcaacatcctgtggtccgacacctttgactggttttccttttaaataaattccgatcacacctggcatattgatatcataagttctgttaagaagctgttttacaagctctggtccaccttctcccattgccatggttccaagtgctccataacgtgtatggctgtctgatccaaggatcatctttccaccgccagctaacatttctcttgcgaactgatggatcactgcctgatgaggtggtacataaactccaccatatttctttgcagctgttaaaccaaacatatgatcatcttcgttgatggttcccccaacagcacacagactattatgacagtttgtcaatacatatggtaccgggaatttctcgattcctgatgctcttgctgtctggataattccaacaaacgtaatatcatgagatgttaatttatcgaatttaatctgaagtttctccatgttaccagatgtattgtggtctcttaaaataccatatgctatggtgttcttagaagcttcttccttggataccacttcacctgtaagctgctttaatgcttcggcttcagattcttttaccaaagttgttccgtctaccagatatgcaccttctgaaaataattgaatcatgtatctgtcctcctgcaatgcatttttctagttattataacatacttctacactttatggaagtaaaacgttaaaaaggtgcagacaccaaggctctgcaccctatatattttatttattctaaataaggatcatatatactgttgcaattgaaataacgatctgaatgatcgcaaatctgaaaacagtctgtgtattagaccaaccgattttcttacgaacgtgatcatgtaacggcatcgttgtattcgcaaaaatatgtatctttaagaatctaagtaatgctactttcacaagtcctaatccaccatccaggatcagaatcaatgcaactaataagaacaagaaaggacttcctgtcttaagcactgccaaactgataaaaattcccatggcacggcttcctgcatctcccatcatcaaacggcttggtgttgcattgtaccataaatatccaagaatacatacaacaaacaataaaataatatatggaaactgtgtttcatttccacggatctgatcgatcacatagatcgttaccagtgtaatgatcgttaatgttccagatagtccatcgactccatcagagcagtttgttacattgatcgctgcccatacaagaatgatcgtaagaataaagaacaacactggtggaatatagaatttcacgccgatcgttgcaagctctacataagtagaattaaaatgaatatagttaagtgctgcaactgctgctaccagaaagtcaagaattccttttttgtattctccccatggctcatctgctgcatcatccataaatcctgttaacatttcaacaaaaacaagaacaagataaataaacatctccacagacatctcgccaaacaacaatgctgcgatacaaaatacagaaataaaaatgatccctgcacctcttggttttcctgcggataactttccattatgtgcaaattctcttcccatatctcttggcagccaatcatttaaaaaggatgtcaggatacaggttgcagcaaatgcaaaaaatactccgataaatgccgtgattggtaaaacacttccggcaatcatatttaacattggtattcctcctaattatctttttagtacactcttttttatcacacaattatctagtatatcacggatttaaaatattgcaattcttattttcataaactccgcgtgttttgttctatttctgcttcatctcctctacgaggcttctcagctgttttgtatcttttttaatgtcctttgcagcaaagattgctgaaacaactgccactccatcaacatccgttccttctagtgtcttgatattttcttttttgatcccgccgatcgctaccactggaatctctactgtatgacagatttttttaatttcttccttagagacaacattggcatctttcttggttgatgttgcacaaactgcaccaactcccaaatagtctgcaccgcctttttgtgcttttattgcttcctctacattgtgcgcagaaaccccaatgatcttatcttctcctaataattttcttgcctcttctactgacatgtcattttgcccgatatgaactccatcagcatcaactgccaaagccacttctatattatcattgatcacaaatggcaccttgtattccttggacagttctttcatttctcttgcttcttttataaattcttctttggaaagatgtttttcacgaagctgtaaaaaggtaattccaccctccaaagcttccttcacctgatccatcaaggtagtgtcttttacccatatcctgtctgttactgcatataaagtcattgcatcagcatttactctcaatttgactgctcctttccatccattctgcattcatattactcatcgcatccatcagatgcactttcaatgtacctgttccttctgctttctcctttgcatattctccacagattcccatcgcactaactgctgtcgtcactgcttctaagatctgatctggattagctccgataaatcctgcgatcacaccatccaacatacatccggttcccgtgatccttgacatatccaaaacaccgttatcgatcaaatagatctgctgtccatccgtcactagatctgtttttcctgtgatcacgatcactgctttggtcttcttcgccatattctttgccatttgaatcacatattccaaattgtcttctgtcacagcatcatctttcttcgcatcaacaccataaccatcatcactgccctcatataaggttttgatctctgatatatttccacggatcacgttaaagtggatctgcttaagcaatttcgccgctgtttcttttctgaatctggaagcaccgactcccacaggatcaaacacgaccagatgaccccgttgattcgcttcttttcccgcaagaagcatggatctcactgtattttgttttaaagttcccatattgatcacgagactgtcacacattgatgtgatctctctaacttccatccagtcatctgccatgatcggtgaagccccgatcgcaaggatcatattcgcaacatcattgatcgttacatagtttgtaatacaatggaccattgtctgatttcttctgatattatcaaaaattctctcaaaatctattctcttcatctgattccttcttttctcctgtctcctgcattcattgcagattataccacaaatattaaaaaaggtatactggcgaattttctcacactttataattcccagaatactataaactgtaaataaatcttttggaggttttaacatgagtgatttagctgcaactggctgtggaggatcttgtggttcatcttgctttggaggaaataacagctgtctgcttcttttaatcttactttgctgctgtggaggcggaaataatgatggctgcggatgcggaaacggatgtgacagcctgatctggatcatcttaatcctctgctgctgtggtaacggcagctttggatgtggcaacaacaatggctgcggatgtggatgctgaatttaatgatttctgataaaagaggatgccttttgattcggcatcctcttttttattggcagatcaccagtaacagccaacagatgatccacatattgttctgattccttttttctggtctcttctgcatccgatagttatcattctcttgtttttcctgtttcctcttttcttccagttgtctttgttcttctttgtgccttaagcactcaggatccagttcataaactgtattttcttcttctaccaaaatttcattcataatttttttcaccccctaatactataggatatgagaaaaaatctgaaggttgtgacaatcatggaacaaaatcaaacttcctgggaaaattttttccgtaatgactcttctaatatgttagaagatgcccttccatatctcccaccaaacttaaaaaaggttgctgccatttatatcaaattaaccgaactttccaaaatctcttctgaatttgacaacgaacagactctttctgcctgtggttttgatcaagatcctgcttctatggaattattactaaatgctctgaaacttcgcgccccgaaggaaaccgctatgcagatcgaacaaattcttcagatgatgcaaatgtttgaagtctatcaaaattatcagcgttttgtcgatacgactaaccattcatctccctcatcttctgacagccaaaacaatgatctattttcaaaactaatgcctatgatgatggcaaaagacagtccttgtactaatacagcaaaaccaaattctgactttatgaaccagttaaaccagattctaaaaaaataaaggagttttttatgtctgacgatcctatttcattcgatcatttatcttctcttgacccaaaaaagctggaaatcataaaatttgtgatctccagctgccacggaaaacctcttgaattaattctcccagaccttatggcggcttcaagccgtctttcagaacaaggtctttcttttacaaacgaagaaatttccatgatcatcgatggtctgaaagaatccatgtctccagaagaacagcagcggatcgatatgatccgtccactgatcatgtaatttaggtttaagaaagcatttcttttgctttctttaaataaccgcggatcacatcacaggaatgcgcaaattggcttttctcctcttctgtaagatcaatttctacaatttcttctattccgtctgctccgatcacggccggaactcctgctgccacgtctttctgtccatactccccatccagatggacagaaagcggccagatccttttctcatcgtatacgattgatttgacgatcccacttaacgcgatccctattccaaattctgtacttttcttaccgatgatcactgtcatgcccgcctgtcgaacctcgtcctgtagatcttcgatcgtaatcttgcctaacgtatcaggatactccttttgaagttttgcaaatggtttccctccgacagacacacgggataatggaacaatctgagaatccccatgttcacccatgcagaatgcctctatggaatttctgtgatatcctgttttctcttctaaaattctcttgatccttaagctgtcaagactcgttcctgtgctaaagcaacggaatctctcgatacctaacgctttcctcaaacattctcctactacatccgcaggatttgtaatactgatcagaattcctcgaaactttgtatcttgaatctttggaatgatatctttcaatcgttccatggaatctccgaacatgtcaagtcttgtttctccctccttgcggcttcgtccgatcgcattgacaagaatatccgcatcgtcaagatcttcataactgcctgaacgaatcacaactttcgcaggaagacacgctcccatatcatcaagatctaatgcctggctttttgctttttcttcatctgtgtcgattaaaacaatttcatttgcaagaccacgaaacatcaatgacaatgcacagtgtgttccgacatgtcccgctcctaaaattacgatcttcgtctgtttcatctgcttttccttccatctaatatctatctacattcaatcactgcatatggtttttgtttttcatcacacaatgctaccagtgtcctttgttcttcccttgcatatcttggatatagaatatctccttcatacgcctgttttttatattcgaccctcagctgtctgatctccaaatcttgtggcagctgttcaaatgctgttttgacataccagctgttattgacatgatcattgctatcgatccagcttctttgtactttcactggttctttttcttcccattctctggaaagtttaatctttcttggttcatattccatctctaatggggcttctaatttatagacctcaatttcttctttggttggcctgactggcattcctgtttctgtgtttatatatacccagatagaattggcataagctaatcgttccccctgtgttgtcttcatgataaaatttctcgttgcatgaaacttgtcaaatccagatccccatgttccaactgtgatcttttcacattcctctggtcttctttccaaaacgatttgccatgaattcaggatccatgtacgtttcttattggcaagatattctactccaacacccagttcttcagactgaaatgcactgcagtcctggaaataatcaactactgccggaattgatagtctgccacttctgtctatttcactgtatcggattctgctgtcaaatgtatacatgttttagcctttctgatcttcatatatccttactgatcttgagaaaaaaacgacgcagacactgttatcgttatctgcgccattttattattctatttctgaacgatatttacaattcttcctggtacataaatttctttcacgatattaccgtttaatttatctccaagaacttccttagctttcgcaagaacagaatctttgtcttcttctgcaccgatgacaagttttccttttactttaccattgatctgaacaacgatctctacttcatcctctttcatagcttcttcatcatatgttggccatgtctgagcaaatacgctgtcctcatgtcccattgcttcccataattcttctgcaatatgtggtgcaaatggtgcgagtaatacaattgctgtctctaaagtttctttgtcaactccagatttcttagccattgctgttaatgtattggtatattccataaatccactcacaactgtattcaagctgaagttatttaaacgtgttgtgatatcgtagatcagtttatgacgtacttttaataattctttatcagcttctacacctttgtctttctgatccatgataagtttgtagaatcttgttaagaatctatgcactccatcgataccgctttcatcccattcagcatctaattctggtggtccaacgaacagttcgtacattcttaaggagtcacatccataatctcttacaagatcatctggggatacgacatttcctttggacttactcatcttgataccgttcttacctgtgatcattccctggttgaacagtttgtggaatggttcatcaaagtcgatcactccgatgtcacataagaattttgtgtagaatcttgaatataacagatgcaatacagcatgttctactccaccgatatacatatctactggtaagtatttgtctgctttctctctagatactaattcttcattattcttgttatcgatgtatcttaagaaataccatgatgatcctgcccactgaggcattgtgtttgtctcacgtttcgcatccttaccacatacaggacacttacagtttacccagtcttcgatgtctgctaatggagattctcctgttcctgttggttcgtatttctcaacttctggtaatgtcaatggtaattcttcttctggtactggaactgctccacagtctgggcaatgaacgataggaattggttcaccccagtaacgctgacgactgaatacccagtcacgtaacttatagtttgttgtcttcttaccgattcccatctcttcgatgatctttggtgcttcttcttttaattcagaagattcttttccattccagtctccggaattgatcatgataccagatgcttctgtgtaagcttcttccatgttctcaatctctttaccatctttagcgataacctgaatgatcggaatgtcaaacttcttagcaaattcaaagtcacggtcatcgtgcgctggtacacacatgatcgctcctgtaccgtaatctgcaagtacataatcagataaccagattggtacttttgctccattgatcgggttgatcgcatagcttcctgtaaatacacctgtcttttctttatcctgcatacggtctacagatgattttagggatgcctgatagatatattcttctactgcttctcttgtctcatctgttgcaagatctttcgctaattcatgttctggagctaataccataaatgttgctccgtgtaatgtatctggacgagttgtataaactgtgatctcatcatctcttccatcaactttgaagttaacttctgcaccgtggctcttaccgatccactctgcctgcatcttcttaactttctctggccagtcaagtttatcaagatcagctaacagacgatctgcatatgctgtgatctttaacatccactgtcttaagttcttcttggttacgtctgcaccgcagcgttcacacttaccatttactacttcttcgttcgcaagtcctgtcttacatgatggacaccagttgatcggcatctgtttctcgtatgcaaggcctttcttgaacatctttacgaagatccactgtgtccatttgtagaattctgggtctgttgtgttaacttccatatcccagtcatagattgcggaaatctcattgatctggcgtttgatattcttaatattggcttctgtagaaatacgaggatgtgttcccatcttgatcgcatagttttctgctggaagtccaaatgcatcccatcccattggatgaatgacatagtatccatttaataatttgtaacggctccatacatcactgatcacatatcctctccaatgtcctacatgaaggccacttcctgatggatatggaaacatatctaaacagtaatatttaggtttcttaccgtcatttacattgacaggatgttcctgccagtgttttctccacttttgttcgattgccttatggttataaggtgttgccatattttattcctcctagccgtatctatctctggccgtcttctttctatgctttgtgaaaacagctgataaattctttaatcttatttattttatcatactgaaatgccgtgtcaactctcccgtcaaaaaacttcgaaaaaaagaagaatgtatcgttaaaatacatccttctttttaagattccttactgctgtggctgtgctgttgactctgttgatgttgtttgctgttctgtcgttcctgttgttgcctgttcaaactgaactttgatctgttttgtcactgtcactccattcttacctttgtaagaaacattcgctgctgtgactgttcctgcctgatctttgactagaacaactgtaactgttgtattcgttcctgccacaaccgttccattatcattgattgttacaactgcacgaactgcattgatcactgtctgatctgtacttgctgctggtactgttacaatttcagcagatgtattgatctgggcatttacatttcctgttaccgtgatcgtaatcttctttgttgctgctctatatggtttgtttgtattcttaacactgtactgtaccgcatattgtccaggtttactaaacttatatgctttggcttttgcatatgtataagttgtgtaagcagatgctccaggtgctttgatcttcactgtcattgcacttgttctgttagctccacttctcatcttcgctgttacacctgttaccgcgtttgctgtattaactttcactgtacggttctttgctgtgatcactggtgctaatgtatcaacaactcttacaaccatcgtctttgttgttttaactcctaaagaagatttcactgtatacttaatacgatatgttcctaaagattttgttgaaaattttgcttttctgtatttaccttttacatattttgttgttgtatatgtaatgttctttgttaagctcttctttgtgatcttgtctttggctgtaactcctgattttacgttataagaagttccatattctgctgttttagctttcttcttagctactgtcaatgtagctttctgtttacggtatgggttcttcttgcttggatctgttggatcccaatactgtcttcttgctgtagataccttgatcccttttggttttcctaaaggtcccggattactgctgctatatacagtaactttcgttcctaatgcacaattatcatagatccactttgcatctcctactgataaacggatacatccatgagatgcagtctgtccaagtttattaaactgaaccgtagactgtgttgaaggattcttttcataataccacacggaatggaataagactcctccatggactcttgtacagtactgcccataacttggtcccattagtgtctgccaacggtacttggctggtgtataaaatgtacctgctggtgtattggcacctccacaagataccaggaatgctttgatcggtttgtatgttccattctttaactggtatacggttgctacattggcctgtttgttgactttgatccaatactttgtattggctgcttgtgcagtctttggtgttgcaaatgagaatccaaatgctgtcacgatcattaataccactgcacaaagttttttacatcttaatcgaaatgttttcatgttgctccttccttttcgttcattcttcttatcattatatctttgcattttgttcttgtaaacacgtaaatttgttgttattataattttaaaaaaaacttaagaattgtaagaaaggatgtacatatgtttcaatttaatcactttaattttaacgttttaaatcttgagaaaagtttagagttttataaagaagctctcggacttgatgtagttcgtgaaaaggatgcttccgacggaagttttaagatcgtttatcttggggatggatcttctgatttcttattagaacttacttggatgcgtgaccagaaagaaccttataatcttggggatgaagagttccatctggctttgactgcagatgattttgacaaagcacacgcactccatgagaaaatggaatgtatttgttttgagaatcatgatatggggatttattttattaatgatccagatggatattggattgagatcatccctgcgaaatagtatattaaaggatattctatgttttaggtatttttataaaaagaagcaaatccaagtgtttggccgggattcaattccccgatcactacttgaatctgcttcttttattatgatactatattttcctgcaatttttcaaatcttatctgcagtttttcaaaaatgcttcatatcctttttccacttcatagatatcagatttgcttgtgatctcccatggtgcatgcatgcttaacactgcaactccgcagtcgatgacgttcatgctgtaggcagcaggaatgtaggcgatcgttcctccgcctccttcgtcaacttttccaagttcagctgtctggaaggctacttttgcttcatcaaagatctttcttaactgagcgatatattctgggtttgcatcatttgaccctgattttcctctggctccagtgtatttgtttaatactaatccttttccgaaatatgcacagtttttcttctccattacacttggatagtttggatcgaaagctgcgcttacatcagatgataacatgtaagaattctgcagcgttctcctaagcctcagatcattataatctcctgttaaagctaagatttctgcgactgtattttcaaagaatctggagtgcattcctgttgctccaacacttccgatttcttctttgtctactaagatgcagcaagatgttctctttggtgcttctacatttaacatagctgctaaggatgtatatgcacagactctgtcatcttgtccataagacatgatcatactgcggtctaatccaaagtctcttgcttttccagctggtacgacttcgatctctgcggataagaaatcttcttcctcgattccatattcttcatcgaataactgtaacaactgtttcttgactgcttctttttcttcgccttttaatggtttgcttccgatcaggacgttaagatcttctccttctacaatcacatttcctttcttctgcatctgttttcctgataaatgaattaaaaggtctgtgattcccactactggatcttcatctttttcaccgatacagatattgacttttgttccgtctttcttcacaacaacaccgtgtaatgccattggaagtgtaacccattgatatttcttaactccaccgtaatagtgggtgtctaataatgccatctctgtgtcttcgtataatggattctgtttaagatccagtcttggtgagtcgatgtgtgctcctaagatatttaatccatcttcaatcgcatcttctccgatctggaataatgcgatcgttttttccatccatgtgcggtatactttgttacccgcttttaatggtgtctggtttttgatcagttcttctaaatcctgatatccagctttctttgccaattcgatcgactgtgctacacattcacgttctgtctttccattggataagaaatctttgtattccttgcaaagtccttctaatgccttgatatctgcttcttcatatgttgtccatgcattttctcgattcatgctaatgtctccttccatagtgcttctttaaacccgatcaacacaaaatcatctcctacaaccagtgggcgttttactaacattccgtcggttgcaagcagttcgtattgttcttcttctgacatctctggcaatttgtcttttaaccctaactcacgatatttcataccgcttgtgttaaaaaatcgcttcagtggcaatccgcttctttcgtgccagtcttttaactcttcgaccgttgggttgtcttcaatgatatgacggtcttcgtaagatataccttgttcatccaaccatttctttgccttcttgcaggtactgcattttggatattctaaaaacagcattgtttcgcctcccttgttttcttatctgttttatcatagcacattaggttgtcagcgtaaatctttgaattattttctcaaaataataccagtagtctttttgttttacgctttgctttgcgtagattggaacgctcttttgactttttccattgataagatatttgatctccccgactttctgtccttctttcacgggtgcatcaatgaaagagggtaagatactctcaatctttatcttatctgttttctttaccagaaatgctgccttgagatttcctgttttcagcaagactttttctttaagaccattctttatacttatttctttgatcttgcttgtatctgcaatgatctctcgtctctcgtaatgatctgtggcgtattgaaccagtttccttacatccttccatttataggtcttgtgcggcggccacccactggcaagaacagaaaatgtcatcgtcatgttcttctgctttacagcccccacatagcaatatcctgcttttgaagtgtatcctgtcttcccagaaatcactccttgcatgctggataacaaggcattgtgattattgcagataaatcttctctttctgctgccatctgtaaatgtatattgttttgtctgcgtgatttcaagaaattgctgattcttaatacatcgtgccatgatctttgccagatcctgtgctgtcgtttcatgccgtcctttcttatctataccatccagaccatttggtgttacaaaatgggtattcaaagtacctagattttctgccatctgattcattcttttttcaaagttttccacacttccttctgcatgttctgctaatacaactgcacaatcattataggactctaacattaatccgtagagcagatctttgactttatacttttccccttctctcacccctaatcttactttcggctgcatcgctgcattctttgaaacttctgccatctgatcaagatcacagtgctttaaaatatataaacatgttaaaatctttgttgtactggcattcggcattttttgatctttggatttctcatagaggattttcccactttcagcatccatgatcacagctgcctttgcatttaagtttatttcttctgctgacactgcatatatctgtatactacatattatcacatataaaaaaacagaaacaatggttttcatatcctgtacccttcttttttgcttactttaaggttcaatttaatacaagtatatggaatccattgtttctttattataattttatgataaataccggcattggcggattgtttttcttattggggaagtcctgtcttgcaataaaatacttacggtcatctagctggcttaggtattctagcaccccatcacgttcttcaaaaccactgtcaccgccactgtaaatacagatgctcataatcccacctgtctttagcatcccaagtcctgcttcaactgcctgaatcgtcgtgttggtctttgtcgcaagatgatggtccccacctggaagatacccaagattgaacataatacaagatactgccatctctttgacgtattctttcatatgctcatggccatctaaaatcagttctgcattcattttatgtttatccagtttttctctggtctgtcttaatgcatctgcctgcacatcaaaggcgtagacttttccgctttctcctgttttgctgcacaaataataggtgtctccaccttttcccatcgttgcatcaatacagcagtctccttctttgatatattcatctagcactcgatgaatccagtctgtcatagtaattctcatttctttggttcctatttaataatatgttacaaccgggtctccctgacttacaagtttgtataatgtagccgcagcatatgttggaagattgacacatccatgagatccattggatatatattcgcttcctccaaaagaacctctccatggtgcagaatgaaaacctacatttccaatgaatggcatccagtatttaacatcagaactgtatccctgtccacttaatgttgcacttggctgtttataaaggatatatgcaacacactccggtgtcttacggtctgctgtcatcttacctgtaacacaggatgttgtgaatttaagttttccttttttgaaatagtaaaccgtctgtgctcccatatctacttctacataagtatctccgatatcaccattgacaccatcgtaaacttttcctttttctctccagtatggctctcgtgtctctgttgttccatttgctaacatcttcttcacagaagccatttctttatccttgctgatacgccatccataaggtccaccgtaaatcttctttgtacgtccatcatgtgtcttaaacttgtgccatccatactgtgtattatatttgtacatgaatttcaatacccagttttccatggcatttttatctactgtatatcctgaatagtctttcttgatcttcaaccagctgctatatgtattcttatcaagaactaccacttgttttccaaatttatatgtaatacttccttttaattttttgttcatatcttttgtcagattgatcaatttatcattgtcagaagtatactctggattatcatagcagttttctttatccagtgagatagtagaaagaccatctttcactgcttctccaatcttcttagctgctacatcttttttaagttctgttccttcttcttctttctgaatctcgaatttgccatctttgtatactggttttgcatttgcgatcttgatcatcttcttgttgttaaatgcatccagtttcttataggcttttgtgaaagaccttgtatcatatgaatacattgtcacattatcataatgttctgaaccaaataagcccttgatccatccaaaagatccctgatcttccttaatctgtttaatctcatcagcaccttcaaactttgttctgagctgatcacttgttaatgtctctgtcttgtcttttctttccttgatcgttaatgaatagtcatttgctttcttatcaaacatctcaatcacttgatccgctgtcttgccagcaacattcattccattgatcttagttccccagaagaatttattactgaaactaaaaccaatcactaaataaattaccagtaccgcaacaactgcgattccaaggtaatgtttccacgtcagttttttattttccatttgttttatccctcctaaatacaatttcatattatagtacaatctttgtaaaataactacactttttttgtacttttataaaatcaatttttcatcaaatatttaaactgctttgataattttttaacgttttctcttgtacttactgatacaaaatgttagaatataactagtgtgttaacaatgaaactatcgtttcatggaatttatttttaggaggacttattatgtcattcacgcaagaatatcaaaaaaaattaacaactgctgatgaagctgtcaaagtcgtaaaatccggagatcgtctggaatatggatggtgtgttactactccagttgctttagacgaagctttagcaaaacgtatgcctgatcttgaaaatattcagattcatggtggtatcgttatgcgtccattagcaatcactcagattgaaaacccagcagatcattttacatggaattcatggcatatgggtggtttagaaagaaaatggatcaacgaaggattctctttctacgctccgatccgttattctgaattaccaagctattaccgtgattgtcttccaggaacagacgttgttatgatgcaggttgcacctatggatgctcatggatattttaactttggtccaagtgcttctcatacagcagctatgcttgaaaaagcaaaatgcgttatcgtcgaagttaatgaaaatatgcctcgttgccttggtggtttcgaagaaggtatccatatttccaaagttgacatgatcgttgaaggaaacaatcctgctattgacgaattaggtggtggcggagctgctacagaagtggatcaggcagttgcaagactgatcgttgatcagattcctgacggagcctgcttacagcttggaatcggtggtatgcctaatgctgtaggatctttgattgcagaatccgatttaaaagaccttggtgttcatacagaaatgtatgttgatgctttcgttgatattgcaaaagccggtaagatcacaggtgctcacaagaacatcgaccgttaccgtcagacttatgctttcgcagcaggtacaaaaaaattatatgattatttaaatgataacccagagtgcatgagcgctcctgttgattatacaaacagcatcgctacgatttcatctatcgataactttatctctatcaacaatgcggtagatgttgacttatatggacagatcagtgctgagtcttcaggaatccgtcagatcagtggtgccggtggacagcttgatttcgttatgggtgcttacttatctaagggtggaaagagttttgtatgcttatcttctactttcacaaataagaaaggggaaacattctcaagaatccttcctacattacataatggatctgtcgttacagatactcgttcaaatgctcattacatcgttacagaatatggtatggcaaacttaaaaggtaagtctacatgggaacgtgcagaagccctgatcaatatcgctcatccagatttcagagatcagctgatcaaagatgcagaaactgctcatatctggagaagatccaacaaataagctaccaatcgattattttaataattgttttttaaattttccaaaccaaataaaaatcccggatcttttacggatccgggatttttatttggttatttaatttttacattttctatattcttaatgatgatcgtactgcctccgcctggctcttcaatgatctcaacattatctttggtattatattcttccatcggaatcttgatctcaattcctgtatccgtctctaacatctgatattccagtttcttgactgtattttcttttgctactgtaaatgtatcatattgcatatcatatcgttcaatcttctcatcgaattcctgcttcttaccttgatgatttccaaatagtttatccccgatctcattcaccttaaacgcctgattttccgtaaattcttctcttaatcggcttttcatgtccaaacgtttcgcaatcccatcttctggataatggttgtttatatcgttaataactttatttagaatctgaaatttcttctttggtgccagatctgcatagcattgtaagaatctctcagaaagatagttgatcttatccccgttcaacatctcatactttttctctacaagacgtactttgtattctgtcagatcgatgatcactgcttctgtaagctttgccgaatccgttggcataactctttgtttcacgatatcatttgcttctgcatcttcctcttctcgatgtacataagtcactttgtaattcatcttaagcagtgcgatatgaattacactttgtacctgaaaagtcacacaaagaagatccgctgcaggaatcgttacactatcacacatgatatcaaacagattttctcctaaaactcttgtcgcctctataaagctctcatcatctgattcttccatgctctctaacaaacttaatactggcgaaacacttccattgaactgacatctttttgcatcatcactttccataattttaaaaatatgtcctctgacaaattccattaaatctggtcccatctccaaaagctgactggataagccaagatatcctgtgtggctgtccaaaatatgtaaaattccttttctgataataatatcatctttctgtatatgttccatgattgattgtctcctttttgttttatccattgtgtatcattttatcatatcgatcatttttacgcaaaaagaaagaatcctgctatacagaattcttctacgaaaataaaaagtcatggttccctacaccatgacttcttctaatatgaaaaatccccatgtattcccaccaatgaaggatcggcaaccccttgccggtgatcttactgtgaaccccttcacaaataaaatctgtggaaaacataaaatttcatattctaataggaccaacttctgatattctcctcggtatagcagattctattatctggctccctacttcctgacaacaaaaaaccgttcatagaattatctcttctataacggctgcctctatctggattaaatacccatatcacattcccttaatgctaaatgtggcaaccggctgtcatagtccaataagaccttagacccttctggctttgcgtccctgtctttcaacaggtttgccctatgaataaatatgaacttttaactatgcatatagaatatcacactttccataatctgtcaattatttttaacaatacataaagtccgcggaagtattgatccgcggactctttaaaaattaaattctcaaaaaatgattatttaacaactgctcttaatttttctgttaaagctggaacgatcttgtttaagtctccaacaattccgtaatcagctacatcaaagataggagctgtttcatctttgttgattgcaacgatgatatcagattcttccatacctgcaacgtgctggattgctccagaaataccaattgcgaagtatacgttaggacgtacagtttttcctgtctgtccaacctggatatctcttggctgccatccgttatcaacaacggcacgagaacagcttacttctcctccgagaacttcagctaattcttttaacattccaaatccttcttctccaactccacgtccaccagatactaagatcttagcatccatgatatctactgtatctgtaacagatttaacgatatccatgatttcaacgtatttgttgtctggagtaaatccaggattgtattcgataacttcagcttttgctccttcaataggatcaatcttctgcataacaccaggacgaactgttgccatctgaggtctgttgtctgggcaagcgattgttgcgatcgtatttccaccgaatgctggacgagtcattaataactgattgtgtttctgttcttttcctgggattgctcttaatgggaaatcaccgatttcaagaactgtacagtcagctgttaaacctgtctgaacacgtgcagatacacgaggtccaaggtcacgaccgattgctgtcgcaccaactaacatgatctctggtttgtattcattgatcacagatgctaatgcatgtgtatatggttctgttctgtattcttttaattctggatcgtcaactacgataactttatcagcaccgtattttgcaagatcatctactaatcctttaacgtcagaacctacaagaacagcagttacgtctgtatctaagtcttttgctaagtcttttgcttttccaagtaattcgaatgcgattccgcttaattcgttatctacctgctgtgcaaagacgtatacgcctctatattcttctaaacccattttattcaccacttttccttttcactaaattacatgtttttcagctaatttatccatgatataatctactgcttcttctggatcaagtgtaactttttctccagcaccttttcttactttgtcagatgcttttgcgatcttagttggagatccagcaagaccaaggttagaatcctctacatctttaaggtcttttcttccccaaacagttacttctgcatcatatgcatcaaaaattccacctggagtcatatatcttggctcgtttaattcagctaatgctgtaactaagcaaggcattttagcttttaagatgtggtatctatcttcatactgacgctgtacaactacgctgtcaccgtcaattttaatgtcttctgcataagagataactggaatatcaagatgttcagaaatctgtggtccaacctgagctgtatcaccatcgatagcctgacgtcctgtgatgatcaaatcatagtcaagatttcttaatgctccagctaatgtagtagaagttgcccatgtgtcagctcctcctaatactctgtcagttacaaggatacctttatcagcacccattgccatagcttcacgaagaacttcgtcagcttttggaagtcccattgtaagaactgtaacttcagctccatattcatctttaattctaagtgctgcttctaatccagctttgtcatctgggttcatgatagtaagcatagcacctctgtctaatgtaccatctgggttgaatttaactccaccttttgtatctggtacctgttttacacaaacaactatcttcacggtaagtacctccctatttcaataagtttccagaaataaccatacgctgaacttcagatgttccttcgtagatttctgtgatcttagcatcgcgcatcatacgttctacatcgtattctctgatgtatccgtaaccaccatgtaactgaacagcttttgttgttacttccatagcaacttctgctgcatataatttagccatagcagcttcaacactgtatactttctgagtagctttagccatagcagctttgtatactaactgttttgcagcttctacttttgttgccatatcagctaactggaactgtgtattctggaactgtccgatagaacgtccgaactgttttctttcttttacatattcgattgttctttctaaagcaccttctgcaagtccaagagcctgagaagcgataccaatacgtcctccatcaagagtatgcattgcgataccgaaacctttaccctgttttcctaacagattttcttttggaatacggcagtcttcaaaaattaattcatatgtagctgatccgcggatacccattttcttttcttttgttccgaatgtgaaacctggagttcctttttctacgatgaatgcagaaatttctttcatctttcttccgcgtttttcaacaacacctgttactgcgattacgatataaacgtctgcgtagctaccatttgtaatgaagcacttagatccgtttaatacccattcgtctccgtctaatacggcttttgtctgctgtccctgtgcatctgtaccagcacctggttctgtcagaccaaaagctcctaatttcttaccagatgctaaatctgggatatattttttcttctgttcttctgtaccaaaagtctggattggatcgatacaaagagatgtatgtgcagaaacgataacacctgttgtaccacaaacttttgataattcttcaacacacataacgtatgttaatggatcgcatccctgtccaccatattctttaggaactggaatacctaagaatcctgctttagccatttttgctacagtttcaactggaaactgttcattttcatccacgtcctgtgcaagaggctttacttctttttcagcaaactctttgaaaagagttcttgccatttcatgtttcttacttaatgtgaaatccattctttattcctccatcatgatttctataaagttaacttttgcatccggagttcaccatctccggatgcaaaagaaaagctctttttcttacttgctgtaatcgtagaatcctttaccagttttacatcctaataatcctccacgaaccatctttcttaataatggatgtggacgatattttgtatcaccaaattcattgtaaagtacttccatgattgcaaggcaaacgtctaatccaattaaatcacctaaagctaaaggtcccattggatggtttgctcctaatttcatagctgtatcaataccttctacagaagctactccatcagcataaattccaattgcttcgttgatcatagggattaagattctgttaactacgaatccagcaccttcttcaacctgtacaggtgttttaccgatttcttcagcgattgctttgatcttatcaacaacttcttttggtgtgttgataccagcgataacttcaaccagtttcataacaggagctgggttaaagaaatgcataccgatcattggacgatcaagtcctgcaccaatttctgtgattgataatgaagatgtatttgtagcaaagatagcatcttttttacagatatcctgtaattctttgaatgtctgttttttgatttccatgttttcaatagctgcttctacgattaaatcgcagtctgtacagatatcttttacacctgttgtgatctttgctaagatagcatctgcagctgcctgttccatttttcctcttgcaacacgtttttctaaaccttttgcgattttagcttttccgtttgctgcaaattcttcattaatatcacataagcatacttcatatccttctgtctgtgcaaatgcctgtgcgattccgctacccattgttccagcgccgattactccaactttcattataattcctcctgtaaaattattttactatgtaattttccggtctgcggctgataccgcagactggaaatatattaaacttcattattatttgttctggaaaggaacaacttttaatttcttagctttgtctttctctaagaagttacccattcctgctttctggtcttctgtttcaaaacagcttccaaaagctttttcttcaacaacgattgcctgatccatatctacctgaagaccttcgttgattgctttcttacatgcacgtactgcgattggtgcattagatgcgatcttgttagctaatttcttagctgctgctaataattcttcctgtggatatactgcattcacaagtccgattctgtaagcttcttcagctttgatgttaaatgctgtatagatcatttctttggcttttccaactccgacgatacgagcaagtctctgtgtaccaccgaatcctggtgtgattccaagaccaacttcaggctgtccaaagattgcgttttcagaacagattctgatatcacaactcatggaaatctcacatccaccacctaaagcgaatccattgactgctgcgataactggaatagggaatgtttcgatcttgcggaatacatcgtttcctgtcttaccgaaagcttctccttctgcttttgttaatgtactcatctctccgatgtcagcaccggcaacgaaagatttatctccagcacctgttaatacaacggctcttgttgcatctaagtcgatcgcatcaaaagttgcttcgatttcttttaatacttcactgtttaatgcgtttaatgcttttggacgattgattgttacaacacctacaaaaccgtcctgttcatatgtaacgaattccattctaagaattctcctttcctaattatctataattaattagtctctttcaacgatagttgtgcaacccattccaccaccgatgcaaagtgttgcaagacctttcttagcgtctctcttctgcatttcatgaagcagtgtaacgaagatacggcatcctgaagctcctactggatgtccaagagcgattgctccaccgtttacgtttactttgctcatatcgaatttcagatctcttgctactgctacagactgtgctgcgaaagcttcgtttgcttcgatcaagtccatatcgtcaattgttaagtctgcttttgctaaagctttctttgtagaagctactggtccaacacccatgatagatggatctacaccaccaagagctcctgttacatatgtagccattggtgtaacacctaattctttggctttttcttcgctcattactacgactgctgctgcaccatcgttgattcctgatgcgttaccagctgtaacaactccaccttcttttccagagcagcatcttaatcctgctaaagattcagctgttgttccagctcttggtccttcgtctgtatctacgataactgttttctttctctgttttacttctacaggaacgatctcatctttgaatcttcctgattcctgagctgcgactgctttctgctgagaagctgctgcaaactcatctaattcttcacgagttaatccccactgttctgctacgttttcagctgtgatcatcatgtgatagtgattgaatgcatctgttaatgcatcgttaaccattgtatctaccagtgttccgttattcatacgatatccgaaacgtgcttttggtaatgcaaatggagccattgacatgctttccataccaccggcaacaacgatatcagcatctcctgcctgaatcatctgtgccgccatgtttacacagtttaatcctgatccacatactacgttaactgtaactgctggtgtttcgattggaagtcctgcgtttaaggaagcctgacgagcaacgttctgtcctaatcctgcctggataacgcatcccatgtatacatggtctacctgatcagctggaactcctgctctttttaatgcttctttgattacgattgatcccatgtctactgctggtactgtgctgagtactccacccattttaccaatcgctgtacggcatgctcctgcgataactactttctttgccatatcaattttcctccatattcttgattattatactttggcgatcttctctctcgccgatatgttaatactatcacaatcttttctcattttcaattgctattttttaaaaagattttcaataaattgtgcaaagtgccaaaagccgcataaatacgtgttttttcgatgtatacaatgtccttgtcggattgtattttttttaacacaatccgacataacttataacactttctcaccgaattgataactttcttgtattttctatgaaataatcctgattttttcgtgaaaaaaataacaatttttacaatataaatatatttacactctttataaattgatttttcgttaaatttacttcactttcaacatgtctaacttaacacatccctgtattttttcattgaaagaaaaaactttttattcctatgaaaaatccccatattttttaaaaacttatttctgtacacgcaaaaaagagagcttggtgtgtgcgttaaaacaccaaactctcttttctcttctatattattgtcttctgatcattaacgatcctgcatactgatacaatcgatcgctaccggaccacctctgactacttcaatatttgtataacgttctttaaacacctttaaaatagaatcattctttgtctctgtacgaattgcttctattaataagctgtcttttcccatatccttgatcaggaaacggaacacttctgccatctggaagatctctgccatctgcttctctgtaagacttttcactttgataaacatgatttcctttgttcggatcgatgtatctgtatagtcaataactttaataacttccacgcttcgatttaactgtttcttgacctgttcaaatgtcttttcatctgcatcaatacagatcgtcatacgagacattgttggatcttctgtttctccaactgtaagactgtgtatattgtaggcttttccagagaatagtccggaaattcttgcaagaacaccagcacggttttctacgaacaaagaaagccatcttctttccatctgattatccattttcattcctcctattcttctccacgttccatgatcagatctgtgatagatccatttggtttcaccattggcataacaagttcttcattctcaatgataaattcaatgatcgttggcccatctgttttcgcctttgctttctcaaatgctgggataatttcttctttcttaaagactctgatcccctgtgctccataactttcagcaagttttacaaaatctggtgtatatggcggacattttgaaaaatctccatcacaatgatgttcacaactctttcttcttcttaaacatgtacctgcatatgctttatcatagaagagatcctgccactgtctcaccattccaagatacccattatttaaaatacagattgtaataggaagttcctgaatcacagctgtcgcgatctcctgggaattcatctgaaatccaccatctccagatacacaaacaacttctcttcctggattaccaattgctgcaccaattgctgctggaagcccataacccatcgttccgagtccaccagatgtcagcatctgtcgtcttccatatagttctaagaactgtgtcgtccacatctgattctgtccaacgtctgttgtaacaattggttcatcaaagtactcattgatcgcatcaataacctgttttggaactaatttttctttttcttccattactaatggcttttgttcatgccattcattcattcttgacagccattcatctactttacatggttcttcattttctgcaatagacaacattaatgcgatggcttcttttgcatctcctaccaatggcacatcaaccgtaacgttcttagaaatcgccgctgtatcaatatcaatatgaatgatcttggcatccgatgcaaatgttccaagttttcctgtaattcggtcattaaatcttgttccaatggaaatcaacagatcacaatcatttactgcctgatttgctgcataatttccatgcattccaatatttccataatataattcatgatttgttggtacgatccctcgtcccatgatcgttgtaacaactggaacctttaatgtttccattaatttgcacatctcttcttgtgcccctgcgatcttcgcacctccaccaattaagaataatggacgtttcgcatcatagatcatattcattgcacgaagaatctgtccatgatgtggtttcgtgtttggtttatatccacggatattgacttcctctggatattcatcacttcctaattctgccattacatcttttgggagatctaataagactggtcccggttttcctgttcttgcaatataaaatgcctctttgatcaggcgattcaaatcctctcttttacggacaactataacaaatttcgcgatatttcttgtaactccgacaatatcgatctcctgaaatgtatcattaccgatcagatttgtggcaacctgtcctgtaaaacacaccaatggcacactgtcataattcgctgttgcaattcctgtaacaaggtttgtggcacctggtccacttgttgccagacagacaccaacttttcctgtagctcttgcatatccatctgccgcatggatcaacccctgctcatgtcttggaagaatcagttctacttgatcctgcttatagatttcatcaaaaatatcaatgacacacgcacccgggtatccaaagatcttctctacgccttcttcctgtaatgcctttaccagaaattcatttcctgtcattttacccatactacatctcctccatctcttcttccagactagtctcatctagtgtatatttcacttcttcctgagcctgtattttaaaatcttccacctgttcttctccaacaactggaagatcatctgttgattttactccaaaacatctcaaaaattcttctgtcgtacgaaacaagatcggacgcccgatcgcatccagccgtccagcctctttgatcagccggtattctaacagcttgttgatcggatgatcgcatttcacacctcggatcgcttcaatctcttgtttcgttactggctgcttataagcaatgatcgataaagtctcaagcattacatccgtaagccttggtttctttggatgattcacaattcttatcaatgatccataatattctgttttggtacaaagctgataagcatcatccagttccaataaccggattcctctctcttctttgtcatattctgtctgtaacagtttgatcaactcatcaaactgttcattatctatctcaagtgcctccatcagctgccgccttgtcacacttgttcccatcgaaaataaaattccttcgatcgctgcaagtttattcttcataaattcattactccagtgcccgtatgaaaatatcatcttcgatattttcctgttgaacgtaaatctttcctgtcttcatcaattcaagaaccgccagaaatgtgacgatcactgcttcttttgtctcctgttcgtttagaaggtcataaaagttcacttctttatattgtataatataattatacacttccgtgatcttatcttctaatttaatctcttcctgcttgatctccccaaattcgcttcggatcggatctaacttatcctgtcgttttctcatcacaaactgaaaaacttcagaaatcctctgtaaagttacctctgataacatctgcacaggatcgatctcttctctgtatgcaagtacttgcggtggaatatctggtgatctaaaaaaactcttctctgccatcatctctcgttctttcaactgtaaagaggcatatttataaatcttatattcaatcagtcttcttacaagttcttctctcggatctccttcttcttcctcttcttccttcactggaagcaacatcttcgccttgatctttaataatgtggctgccataacgagaaaatcactcatcacatcaagatcttcctcttccatagagcggatataatcaagatactggcttgtgatctcagagattggaatatcataaatatccactttattcttctcgatcagatgcaacagaagatctaatggtccttcaaatgcatttaccttaatatctattcccataaatcagtctctcttctttaattcaatgcatgaaatctctggtttattaaacaatcttaatttgatggaatggtttccaagtccacggcttaagatcatcgttgtctctccctcatgaaactctcctgcatcgtattttggaaaaatctgaaattgcggtgagatcacacctccaaatttcggaattcttaccattcctccatggaaatggcccgctaagacaagatcactgccccaatctgcatatgtttttaaatagtttgggttatgtgctaataaaatatgaaaaatgtttcctggagaacttcctaccacagattccatatgagaaagcggcatgcgcggtacatgaaatctctgataatatttcttctcaagatcaaacgcagttaaagaaataaatccagtctctgactgaattacgatcgtttcattcgaaatgtgatgtatgttatactctttcagactatgaacataatctttataccgcacaccaaagatttcttcattccttgcaagtttcaattcgtggtttccatccgcataatagatcggatactttgcagataactctttcatcagtgcaagcggcacttcctcattcgaagattcgcggcttattaccatatctcctccaaccaggatcatatccggtctgcattcatcaatttgttcgatcaattcctgattattctctccaaactgtgcacaatgcagatctgttaaaaacacgatccgatatccatcaaatgcttctggaatcttttctgactctatttcgtaatattcaactgtcaatctcttattttcatagctgcttaaaagcactgccatggcaatccccacaaccaacagcactgctatgatccatatccataaaggaatcataaacactccttctctctgtttcccaatccatcttctgattcgtaaatgtctttttcctattttactagatatagcaaaaaaaaacaacccatagcacaacatctttaggaatattgtacaaaaaaagagaatgcccagattctgacatcctctttttttcattataatattactgtctggaaagcagccttattttacgattgcgatcgtgcttccgatatcaagtgctggaagctcggccttttccatgcagatagttcctggaagacactcagcgtcttctccaccgaagttatatgtaacatgtcctaaattcttcagattctcgttggcaacttctccaacttttacaatcttgaattctttaccgtcaattacaagtttacatccaggagttacttctccatctactggatttacatcgatggaatagcagaaatctttcagagtatctggtgcgttatcaccaaatgtaacgaagatcccttcttctctaaatgcgtctaccatagctccttttcctttaatcgttacctgatacataatactactttcctttctcactaataattatttttattttgctgcatataatccaaagcttgctaagtaaccaacgataactcgaggtacaccagtgataaatcttgagtacagtacagctggtacaccaacttctactgtttcaggatctgcttctgcaagtccaagtcctactggaacgaagtcacaagcacactgtgtattgattgcaaataatgctggaagtgcaaggcttggttcaatgtttcctttaccaatttctacaccgatcaatgttccgacgatctgagcaattacagctccaggtccaagcagacagcttaagaatggaatagaacaaataaatcctaagattacaagtccaatgatatttccacataatggctgtaataatttagcaaaccagttaccgaatccagatccctgaatgataccgatcagcaatgatacgaatcccatgaatggaatgatcgtatgaagtactgtgtttgtagattctttcgctgcactattgaaagtagcaacgactttaccagctcccataccaattttctggataaagcttgattttgatgagcttcccattgtttcagatactttcttatctgcgctgtatttgaagtctttttcttcttttgcaggtgctgcttctgaaataggtgctgcagatccatctgccaatgcaatgttatcatttttaacaccagatacataaatatcttctgtaatatattttgccattggtccagattttccaactgggttgatattgatcgttggaattctcttctgtggataaattccacaacgaagtgttccaccacagtcaatgatcacaaggaagatctcttcttctggaacagatgtcttaaatccgttaactggacggcatcctgttaattctacgattttaggtaagatatcaggttctgctccaccacctgtgatatataataatacatcttttccttctttaggttctactgttaatggaccaccaaatccaccgcttccctgtgtgatcgtaatcgctctatattctgacatagtttttcctcctaattacactcgtaaatccatcttatttcaattcgttacttaattcgattccctgctgtttcataaccatctttgttgtaaagtctgttacccatcctgagaagaagttcataacaagaccaactaacatataacgaagacctaattctgtcatatcaaatccagctttctgaacaccctgtgcaattccaaggtagataaagatttcacctgggttaatatgagagaaaattccactgtttgtatggcaatgataagaagctgatgcataatagcttggtttcattctttctggaaggaatttacccattgataatgccattgggtttcctaacataaatgctgaaataaatggtaatactccatatgcaaggattacgtttcctgaacataatttagcaaatttattaactctttcctgtccaatcagggcgatgatcgtattcattaggattaacagtaataatacctttggtacgattcctgacacccagcttataaatgtttctgcacctgtatcaaataatcccatgaatcctgatgcacctttaataatgatattcatataattctcctttcatttcaggcttttttcttattgacaccgtaaatcttgtctccaattcttgtaaacagactcggcttttctaagacttcgcctccactcataatcgtgttgtaatttgaggaagcattaagcactgctcttcttaaggatacaccgatcgttgcacaatcatcttttttaatcgttccaacatcaattccattaaagaaatcccagtttttaaatcgtgcaagcattgtaaatcctctcataaagcaaccatctatgatcactccatcctgatcgatcgcaaacataacgatcgcacctgcatgaaaaccgccttttgcctttcctatggcaacccggcctttttttcgaagttttgtataaaatttattaaaacttttcatctgcaccatctgaaataaaaattgcagacaaaatgctgcaagcatcgccacagctatgaccataaatgacatcgtcttcctccttttcgcttactcaaatatattattttcttctgcaatatagagaagaaattctctgtagctttccattttctggatctttggaatgacatccggtttcttgccaatcgacaaaatatcatcatataatcggacaagtactgtgtcatcttccattgattcaggaattcccagtaaaataatgattcggatatttccgtatttatcatcttttaacatatctggaaacacacccattgccaatgttaattttgacatcatattctttgtatgtggaaacgcaatattctggtcaagaaccattgttgaatatttttcacgttctctcactctctgggcaaatcctgcatcaagttctccctgattggtaagtgcccttgccatccgatcaacgttctcatcatatgaactttcttgatccagaacaaaaaatctcgtttcatctaataaattcataaacaaagaatctattccctttcggattgttcgtcctgcttcagaaaggtatctcatattttcaaatttacgttgaatatattctctatcgaatacttcatccataaaaatgaccggggttttcgtatccatatgtaattctgtcgtcgtaacaatataatcaaaatcatctttgcgattttcatcgaagataccatagaaaatttcaaattccggttctacatcaaagattttctttaactgattctcgatcagacgtccgatgatctttccagatccacaaacgatcgcgatcttgcatcgtttcttttctggttcctgctctaataaaaacactccaaaataagcagccagaaatcccatctcatcttctgtcatctcgattcctacacgttcttccaaaacaccttttgcaatctccgccattttataggctacactgtatttgttcttgaaatcatcaaccatcggattataaatatgaaagccatattttagccggttgatcataaaaaatacgtgatagacaaaatcatcaaataattcatttgctacaactgttacattaagttctgctttgatccgatctaaaatttcaatgataagatctgcaacaccttccgaaatactgatcttttgctcgatctctgctgtatttgccggtgttctcattcctgctacagatatacttaaaaacaatcgctcttctttggatatcttatatcctttgacctgttcaatttcattaaggaactcatccacgatcatgtatgctgaacttccatacagttcttcatatttcggctccagctttttgatcgtatgtccactttccattctctgaatcatcacaacgaagaatctgtaaaagaaaccgaatcccagtgcatccattgataatctttcctgaaaatcatatagtttttcacgaattatctgtccaagtgggaagtttaaatacagttgttcatagatattctctaagatgaacaggcgaatcttatactcatcgccacaaagagccagtcctgtattggctttccctttgatcttcaggtcgtatttctcaatcacctttcttaatcggttcagatcaccgatcattgttgttctggcaaccttcatctcctcagaaagatcatccgttagatacggttcctcggcatgcatcagctgccagaacatatatgccattcttgtatgactggaattaaaaaggtcttcctgtttgtaaatcttattgcggatttctgtaaaacctttcggtgcaaacacgatcagtttacatgttcctttgttattgctgatacatgcgtatcctccaagcaggcaattcaattccttaatgtcattgcggatcgttttttgcgacacatcaagctttgccgcgaggctttctacactgcaaacagattgcatttcgatattccttaaaataactgcggttctgttttcattgttaaaaagctgtttcatattgatcctcttttctattgatacaggttaattgtttttaacctcttgtttttcctcctgctacgttcactgtaactccatgaacataagaagctctctgacttgcaagatatacacacatatctgcaacttctgataatttaccagatcttcctagtggaattgtagatgttttagaatatccagctcttaagtcatctactgtgattcctcttgtatatgctaatgctgattcataagcaattgtacgaagtcctgtagcttccatgattccaggtgctactccgacaactctgactccctgttttccaagttcttttgcccaagatcttgtcaaagagtttacagcgttctttgttgctgcgtaaacgctctgtccttcagatccttccaaaccactttcagaagacatgttaatgataactccttcacctttttcaacaagcacacgaccaacagcctgtgcacagaagaatacaccttttaagtttacattgcaaactttatcccatactgcttcatctaattcgtactgtccttttggatcttttggatctactaacaaacgagggatgttgattccggcattgtttactaatacgtcgatcgttccgaatgtttctttggctttttctaccattgcttcaacatctgctacttttgtaacatctgttttcacatacagtaattttcctgctgcttcgtccatctctggtgcttcaggtgccatatcagaaatgactacgttagatcctgcatttaagaatccctgtgcaactgcttttccgattccagatgctccaccagttacgatgactgtttttccttcaagatttaaccaagattcgctcattataatcctcctttgaatctgtgtttctttgcttcatgagttcattatatagagcgtcaaggaaaaatttaattctttcattttccatcgtgaagaaattttgtggacttattacaaaaaatggcttaaaatcaagaaatattgagtggaaatttttttaatctgtgtcaaaaaatctgccttatttattgtttcttgtgccaggatcttttctttatggatcataatattacctttgctatattgaatctcaccaatcttctgtcctttcttcactggtgctttcacagaatctatcttgatctttttcacgatctttcccttctgtgttttaatatcgatcagatcagcagtcaccttttcttggcaagatacttctgatctctgacccttttgtactggaatccttccgatttcttttcttgtagtttcgctgtgtatccgctggcaatttgaaaatccatagtccaaaagagttcttgcatctttgatccttgctttagagctttcacaccccatcactaccgcaatcatatgaatcttatttcttgttgcagttgcacttagacaaaatcctgctttccctgtacttccagtcttcattcctgtacatccatggtactggcggatcagtttgtttgtgttacttaaaccaaattctttctcaccttttttcgttttatgtatgatcgtatccatccagatctttgtatatttaaaaacttctggatatctttgtgcaagttctctcgtcatcaacgcaatatcatatgcacttgtcacatgtccttttgcatcaagcccgcaggcattttgaaatgtcgtatgtttcattccaagctctctggcttttttgttcatccttgatacgaacgcttcctcacttccgcagacatgctctgccaatgcaacaactgcatcattcgcacttgagatcacaacacatttgatcaatgtttgtacctgctgcttctctcctgtttctaaaaacacctgagagccgcccatagatgctgcatgttcactgactgtaaccgtatctgtaagtttgatcttaccttgctttaagtcttcaaaaataagcagcaaggacattattttcgttacactagctggtgcaagttctttatccttatctttcgcaaataagatttccttgctttcctgttccataactactgctgattttgctgaaagatcaagtactggtgctgctgtttctaaaaatcttgcctctcttgccatgactggacaataaaagctttgaacgagtattgctgcaacgagcagtatcactttccatttctgcatgcatccacctcaaacctgtttgttatagtttagtggcagatacttagatttatacataatttctttgctgtatatgtttttttaaaaaagaaaaccagaaatatcttctgatcatatctctgattttccttcatttatcttgttttcttaccccaacgattcgcagatctcaactttttatattcatcatatgcttgttttaagatctctttctcattaggaaatttcaataagtggtaagcctcgtgaaatttgtaataccctgagtctacaaaaaactcttccttctgaggttttgagtgatagttctcggattccatcaagtaccagtgtacactctttatgatctgttcatgaaatgaatagaaagaatattcacttttccctacatacttgataattgatgcgtccgcgtctgtctcttcctttacctcacgaagtgctgtctgctcgtgagtctctccttgctcaacagtacctttcggaagtacccagccatcatatcggttcttataacttttgtataacagcaaaatctttcctctaaatattacgacaccaccacagctcgttgcttttgtcaccagttacaacctcctgtctcttaaacgatcttattcgcctaagtatgtgtgtctttctctgacaaatattatacatggattgtgaactgatttcaactgctatctgttttactcttttgaaaatatcaatctaaaaatgcatgaaatactttatctgcgatcggtgccgcaactcgtcctccagagtctccaccctctacaagaacactgactacgatcttcttcccgcctctttcggcacatccgataaaccatgcgtgggaatctttcgcgctgttatattctgctgatcctgtctttccatatacattatagtgtgaagaataagctcttgttccagttccctttgtgacaacttttctcaacattttctttaatgtctcacattccgatgcctctaaaggttctgatagttttgatgcttttgtttccttgatcactccaccgtcgatatttttgacattctctaccagatatggctgcatcacaactccatcattggcgatcgcagacatgaccatcgcattttcaagtggtgtgatcaaagtctgaccttgtccgatcgaagtgtgtgccatctcattagttcctgatttcttatcaagaacaaaacgactgctgtttgcaagaagattgatcggaactttcgaattatacatcagatcgcctgcaagacttgcgagttttcctttgttgatctcttctgacatatgcacaaacgcacagttacaggatttctcgattgcctgttcaagattcaccgttccatgtgcttctcctccataacaatgaatctttaaagttccaaccgttgtatatccagtacaatggtatttgaaattcttatatgtgtttttatgttctctcatatattctaatgccgtcacaactttaaatgttgatcctggcggatataatccttgcgttgcacggtttaacaacaaagaattcttgcttgtatttaattctgtccagttttctttgacgtaagctggtctgtaatccggtttggataccattgcgtagatctttcctgtctctggatccatcgcaacaaccgctcccttttgtccctgcaaggcataatatgctgctttctgaactttggtatttaatgttgtgtatacattatcccctatacttttctcaccttttaagctgcttgtgatctgtgtcatcaagttcgcatccgattttaatagatcaaagttacatacagattccagtcctgactttcctttatcgttatatcctacaacatgtgcaaacattctgccataaggataatctctgatctctgatccattttcagtaagtgtctgtgccagcacctttccatcactactgatgatctttcctcgtactactttctctgccatagactgtaatctccggttatgcgcattcgtgatcacatttttactatctaccgcaacaaaatgtgcaatataagcgatcaatgccaaaaatgatacaacaaatatataagtaatctgcagaatctggcgatttgctctttttttctttttcttctttatcttactgattctttcggttgttttgtcttgtatattgtttttctgattcttgtgccttaatatgctcatattcttcttcctcgctatctgctaacatatgtaatccttgtatgatattaaaaatgatcaaagtactgatcacagaagttcctccataacttacgagtggaatcgtaactccagtggatggaatgaattttgtcacaccaccgatacttaagaatacctggaataagaaacaaactccgaatccaaggcataacaatttgttaaacaattttctgcttcttgtggaaatatccataaagaggataaaactgctcattaaaacgaagatcaggcagattccaaagatcacaccaaattcttcacagatcacagaaaagacaaagtctgattccctgaccggaatatcaaacggccgtccatttccaagccccattccaaaccagcttccagttccaatagcaaataaggattgacagacctgaagtcctcttccttcgatcatggaaaacggatctttccataccgctacacggatctgtacatgagtaaagatcttatctgcgataatagcagccacagatcctgctgccaaaccgccaaataagtaacttgcttttgcggttgcaacataaagcatcatcagatagatcacaaaataaagcaacgctccgcctaagtccttctcaacaacaagcactaatacataaagtgctgcgatcactgtgatctttaccagatctttaaattcctttgccttagaaagcagtgctgcaacaaagaacacaaagatgatctttacaaattcagaaggctgaaatttaagtcccgcaatgctgacccagttatacgccccatacttgttgataccaaacacgaatactgtagacaacagtaaaaatcctgccactgcataaagccatccaaatttattccagatcgtgatcttatgcatcatcaatggaataaaacttgtcacgatcacacttcctgccgcaatcgcaaactgtttcattgccagatcaaatgataatcttgttaagatcacaaacccaactcctaacaaaaaacaggtgttattgatcagcggtcttgaacatcttttatagattctcggaaatacgatcatcaaaatctcgaaaaagatcacttgtgccgcaaaaaagatcaagatctttaattcaaattcctgcaaaaacagtaccgtgtaacataagaacaaaaatacaaacatatagatgacctgattgtctaacaggtcttcctttctatctctattctttggacgaaatactgtataacatgacagtgtatagatcagacacataatgatgatcagatattttgctatcgtagtaataatgtctatcatatggttttataaaacttccctctttaaatgccctgtcgtatattctgtggcaagagaagctctttcccctttctgtatagatttcgctgcatttaaaatctccttgacctgcacctcattttctcttgtaatatgaaaacggatcacggatggatgaagatcattaagaattcctgcttcatttccaacccacaatggttttccattataaatctcattgatgcagtcacaacaacttgtgtgaacgaagaagtttgcattgtaacgatcctttaatgtcagccaagatggagtcttatcacatcctcgaagattattcttcacgcattgtgcagacaccatcaatggctgataaccatagaggaacaggtccgcattcagaagttctaactgttccatctcttttttgtttaattccgatggatacgtcattcgaatttgaatacctgataatctttgatattctttgacagcctctttgttatatccataaaacatgtaatccgcgatcatttccttttggtatccttcttcgatcaaccatgaaaattcttctaaattgcgtacgagcagcccatcaatttcatttgtaaatataagatctttctttgcctttaattcttccatctgacgttttcttgcaatctgtggaagcatcagataacactgttttcctgcagtctttattttattcaggatagattgtggatcctcctgctgtttgagttccatccatgaaagatagatcttcattacttccctgtcttctgttacaatatccagatactcaaggttctccatagaaactgcaatctgtatcttgctgtcttcctgttcctgactgcttgctacatcattttctttgactggatcttcgtaagttcttctgtattttaaaatctttgtctgatccatctgtgcaaatgcttcttttcttagtttcttgagcacagaacctggtacgaacaagttctctccaagatcaacttctaattcttcaaatgtatagtgggtctgtcctgttttcttaagaagcttctcaatatctgctggcatggcaccatttttctgcgcttcttcgatcactggaccaattacttctacgtgatcttctccgtctttgagaatgagtttagcacactgatctttctgaattatgatttttcccttaagattttctttctttttctgctttaatccttcatcaatccgttcgatcattggatgattcaaggttcttttgatttccatgccttcatgaagtttcttcattttctgtccctttaaaacaaccttgctgcctgctttaaattcagagggactggtaagttctactttttcttctgaattgatacggatctgcaaagcatctcctttgtggatatcttcttgagccgtaaaagaaatcttacctttcataagtttgctgatcttcccaacatataacccctgatgatctggccgtttcatactcatcatatcttttccatgatattctttataatatccatcagtaaatcccccacggttaaatacttccatcaagatcttcagatcctcggattctactttatatggtttttctgaaagataaagatctacgtatttgcggtagattcttgtgacttccccgacatatcttggacctttcatgcgtccttcgatctttaaggaatccactccatgatctaaaatctctggtaaatgttcaatggtacataaatctttcaaacttaatggatacgcattctttgtattctttgtcccgtcaagataaaatggcagacggcatgttcctgcacatcgcccgcgattcccacttcttccacctaacatactactcataaaacactgtcctgaatagcagtagcataatgctccgtgaacaaaacattccatgtcaagtcctgtatcatccttaatctcctgaatctctttcaaagataattcccttgctggaacaactcgttttgcacccattttctttgcgatccttgctccatgaacccctgtgatcgtcatctgggtgctcgcatgaatctcaagtttcggaaagtgttttcggatcacggatacagctcccaaatcctgtacaatcaccgcatccagtccttgctcataaaaaggttttaaaaatcccggcagtaatggaagttcttcttctttcatcagagtattgactgtaagaaataattttttaccatacaaatgtacgtaatcaattgcttctaatagttcttccttattaaaattcccggcataagctctggctccaaacatctctccacctaaatagacggcatccgctccatttagaattgctgcttttaggcattccatggaaccagctggagctaatacttcaatttgtctgttctttgttctcatctgttatctatcctctggtattggtaaatgaaaatgctcatatgcacttcttgttacaactcttcctcttggtgttctctgaatcaatccgttctggatcagatatggctcatacacatcttcgatcgttcctgaatcttctccgatcgctgctgctaatgtatcaagtccgactggtcttccctcaaatgtctccatcatcgtctttaataaatttctatctgtctgatccagcccgatcgtatcaacttctaaatgattcagtgcatctcttgcaatctctaatgtgatctgtccatcgtattttacctgtgcaaaatctcgcacacgtttcaataaacgattggcaagtcttggtgtccctctggatcttcttgcaatctctaatgcaccctctggatcgatcccaatctctaagacttctgcagaccgttcaataatcgtctgtaactcttcactgttatagaaattcaagcggtttacaactccaaatcgatctcttaacggtgctgttaacattccagctcttgtcgttgccccgactaatgtaaatcttggcagttccagccggatcgatctcgcagcctgtccttttcctactaatatatcaatggcatagtcttccattgctggatacagaacttcttctacctgtcgatttaaacggtgaatctcatcaataaataagacatctccttcctgcagattattaagaattgccgcgatttctcctggtttctcgatcgctggtccacttgttactttcaaatgtacacccatttcatttgctacgatccctgcaagtgttgtctttcctaatcccggggggccgtaaaacagtacatgatctaaagattctcctcgacttttggctgcctcaataaaaatctttaaattctctttgactttttcctgtccaatgtaatcacttaacatttgtgggcgcagatgattttcaattttgatatcttcttccacaagttctgtggaaatcattctgttttgcataattaccctctatctatatcataatattcttcaatgcttttttaagaagttcttctggggtgagatctttcgcatcttctaccttgttaactgcgatcgctgcttcactttttgaatatccaagacttactaatccttcgatcgtgatcatcacagaatcactgctgtctacagatgtatcaaagatctctgctcccacaccatcttcttctaattcttcaaatcttaacttatcttttaattctaagatcaatttcttcgctcccttaggtccaagtcccggggtcttagaaattgtcttgacgtcttcactgatcactgccatcttaagttcataaacggacagcgttgataatacagacaatcctaccttcggtccgatcccattgactccgatcagaagttcaaatgcttctttttcttcttttgataaaaagccaaataaactgacatcatcttctcttacatgcatatgggtatagatcttgatttcttgtccgatcttaggaaaagattctcctctcatcggaaccatcatctggtacccaatcccatgattgtccacaaccaccatccctggtgacatatcttctagtattccttttatatatgaaatcaatttggtttctccttattctgtctttttccattcgtttcgtattataccttatcatgtcttaacagtccagtctattggatcagaattcacaaataatccgtacgtatgttcttatcttaaatgatcatatgatggagtgtcatactctggttttccattcattgcaaatccgatcaaaagccgatataataaatctgtggatatgattcttgttcacagaaaggatttttatggaacataacatacaacaatctttattttttgatatagaaacaactggattgagtgctgatatctcagcgattactgtgatcggatgctgtgatatggatggaaatgtaacacaatggtttaatgaagacggattatctcagaaacagatcttaactgattttcttgcatttatccaaccttataatacactgattacatttaatggcaaaacctttgatcttccttttttgacatcgaagatcaaggagtttaagatcaatgcatcatttgatcagtatgaacatcttgatctttatcaaattttaaaaccttataaaaatctgtggggattaaagaatttccggcagaagaatctggaagaatatttaggaattcaacgaatcgacaaactttctggaaaaaaactcatcaaaacttatcaagattatcttgagaatggagagatcaagaataaagaatcgctacttttacataaccacaaagatcttatcggtctacataaaatttattcattgatgtcttatcccgcattgcttgataaagaatttactttatcatcctattttattgaaaatgatcattttgttgctcatctgaatcttgatatacagattcctgtcagctgcaattacgaaaagtctggcatatctctgactcttgatcattcaaatgctatacttacatgtcctttggaaaatggtcatctaaaacattacctcaaagattataaaaattattattacctccctatggaagatcttgtgatccataaaagtatgaagtcatttgtggatactacgagtatcattcgtgccgataaaaacaattgttattcaaaatttactccaggagatagcttcttatctgcaaaaactgatgttaccaattattgtgctgacattatttattacattttatctgaaaaataaagtaaaaaaacatccatctgaactttaattctcgatggatgtttctatttttaatctcttccgatctttcggatttcacgatgttgtaaaatttcttgttttaacacatctacagagcgattcactactagttcttctgggaaattcatctcttgtaataagacttccacatgatcaaacacgccaaccgcgcttgaaaaatgcgcatctgtccctgcgactaccggcactttcttctcttcacacatctgaagcatgatctgcagattctgccatgctccaactcttgatgacaaagaatccaaggaactgttatttatctctagcagtgtatgattttcttttgccgcatctacaatcatttcataatcaatcggtattctgctgtcatctggatgactgataatatcgatcattggattctcgatcgcttttacataggcattcgtattttgcgtgacggttccaacttcataacatggaagatggattcccgcaattcggatatccaatgtcttctcaataattttctcttccatacttaaagttccatcatgatcgataatgttgatctcagagccaaacatcagatcgatcccatacatctttcttggaataatacgcatattatggaaataaatctcatcgcatgttccaggaattccttgtgcatgttctgtgatgcctagaagtttcaatcctttatctgccgctgcttttgccatctcctgtactgttgaatacgcatgtccactggctactgtatgtgtgtgtaaatctaatgtaaattccatttttcaaaacctcgttttatcatccacttctgatctttatgaaattcttgcgatctgttctttgacctgttctaacatctgctgatatttggcaagtttgtctttttcttcctgaactttcgcttcaggcgctttgcttacgaatctttcatttccaagcattccttcgcaacgtttgatctcgccatttaaacgtttttcttcttttgcaagacgttctttctcttttgcaatgtcaactaattctgcaaatggcatgtagatcacagctcctgcgatcacacttgatactgcatcgtctccgattccgtctttgttatcctgaatgataacttcacttgcatatccaagtgtagcaaagaaaactttcccttgttcaaaaatatctctgatctccgcatcttcagataccacgtaaacctgtgctttcttctttggtgatacgttcatctctgcacgaacattacggattcctctgactgcttctttaatcgtctctacagccttctcatcagccttgaagttccattcttctttgaactctggccattttgctaacatgatagattcttcatctgttaaattacaataaatctcttctgtgataaatggcatatatggatgtaacagttttaatgcttctgttaaaactgtatttaacgtccaaagtgctgctgcctttgtctggtcttcatcattgtacagacgaggttttaccatctcaatataccagtcacagaattcttcccataagaagtcgtttagtttctgaactgcgataccaagttcgtatttctccatgttgtctgtaacatctttggcaagtgtatttaacttagataagatccatttgtctgcacttgtaagatcttctaatgtaacatcagagaaatcagcctgctctaagttcatcataatgaaacgagatgcattccagatcttgtttgcaaagttacggcttgcaataacacgtttttctgtgtaacgcatatcatttccaggggcatttcctgtgatcagtgtaaatcttaaggcatctgcaccatactgtgcaatgacatccaatggattgataccatttccaagggatttactcattttacgtccctgttcatcacgaactaatccatggatcagtactgtgtcaaatggactctttcctgtctgttcgtatcctgagaataccattctgactacccagaagaaaatgatatcatatcctgttaccagtgtatttgtaggatagaagtaatctaattcttttgtcttctctggccatccgagtgttgagaaaggccacaatgcagaactgaaccatgtatccaatgtatcttcatcctgtgtgaaatgcttgcatccacacttaggacatacttctggtgtttctcttgctacgacaacttctccacattcatcacagtaatatgctggaattctgtgtccccaccataactgtctggaaatacaccagtcacggatgttctctaaccaatgaagatatgtctttgtataacgttctggtacgaatttcagatctccgttcttcacagcttcgatcgctggttttgcaagttcttccatcttcacaaaccactgtggcttgatcataggctcaaccgttgttccgcagcggtcatgtgttcctacgttatgttcatgttctttgatcttaactaaatatccctgttcttccaagtcagcaacaatggccttccttgcttcatagcgatccataccttcgtatttaccaccattcttgttgatcgttgcatcgtcatttaagatattgatctctggcagatcgtggcgtttcccaacttcaaagtcatttggatcatgtgctggtgtgatcttaacggcacctgttccaaactcacggtctacatattcatctgctacaactggaatctgacgattgcataatggcaattctaacatcttaccaactaaatgtgtatatctttcatcatctggatgaactgcaactgcagagtctcctaataatgtctctggacgtgtagttgcgatttctacatattcaccttcgcttccaacaactgggtatttaatatgccagaaatgccctgcctgatcttcgtattctacttccgcatcagagatagatgtctggcagaccggacaccagttgatgattcttgatccacggtaaatataacctttttcatataatttaatgaaaacttctttgactgcttcagaacatccttcatccatcgtgaatctctcacgatcccagtcacaggaggatccaagtttcttcatctgttcgatgatcgttccaccatattcttctttccaatcccaggcacgttctaagaacttctctcttccaagatcttccttctcgattccttcttctttcagtgcattgatgatctttacttctgtcgcaatacttgcatggtctgttcctggtatccataatgcattatatccctgcatcttcttaaaacggatcagaatgtcctgaagtgtctcatctaacgcatgtcccatatgaagctttcctgtgatatttggaggtgggatcacgatcgtatatggttgttttgtctcatctacttctgcatggaaatacttgttatccagccatttctgatacaggcgttcttcaatcgcacctggatcatacgttgtttctaattctttcttcatctctaaactccttactctatagtttcagaatctgcttgttcaccgattccttctaaaatctgctcatgccggatcaattcctgattgcatatatcttttctatcattcaatgtattcaggtaatcctttcgtttgatcagatcatataaaacctttggatgatacatccagattcctggattatcccactggttcttttctaataatcgttccagatcattggatgcctcaaggatcgcatcgctaaatcttaatctggctgacactttaccacaaaaatcaaataatttccactgttccggtgaaatatatgaaaatactttttcaaatttctcataataaaacttaagatcattgccaatctctcttttatcatcttctaaccgctttccagtataactcttgtgtgtgaccatcatctctaataatttcagctgatcaccagctttcctctgtgactgaaataaaatcacaagaagcaataatatgatcactgctcctgcactcaactgccacagataatctttggcattcatttcaaaatgatataaatatccagcactcactccgcataccactgctgccatgcaaagaaatgaaataaacagtgcctttttatttcttctcttctcctgtgctgccttgatcttcccattcatcatggtctcatcttcattcgcatgcacaagttccttctctaactgtttttgttctccttccagagaattgatcgaattgagtcctgcctttaattcttcttcgcgttcccaaagatcaaaaaactcttcatcactgactcttccttcacaaacatcataaaattctcttgcaaatgtccgataataaagtcttgctttgtcctctacctctggttttatatcaaaatctttctgatcaagtttcttaagatcatggatctgtttctcaatgctttctaactcttctttataaagttttacaaatcgtttttcacttaagatctcactatcattcgacaggtcatcagatagtctgcgctttgtattcatctttccacttccctaaagttgtcttaatcaggcggcgggttatattttcgtctgccttctttctatgataatctattttaccaagtttatcaaactcttctttttgaaaaacttctttttctctttcttttatgttctgatagatcatcttacattgatcttcatcaaaagaaatccttcttcctgcttccaaaaatgcttcctcatctcctgccagatatgctgctgtaaaatacgcttcctgtatctgtttatcttctttgatccttaatgccattgcaaaagattcttttgcctcttcaaaacaaaacatccggctttggcataatcccatatgatatagtacctgaatctgttccgcagcatttaatttccctgaaactgtttcaagtttctggtaagcaatcaatgctcttacatacaattgatgctttaaatacatatctgccagaagtttttgcttctttgcagcagaataaagataagttgtgcgtaatttttgctgaaactggattttctcatctgaagtaaagtaattatagtaatttatcacttccttgacttgctgtaccacatcatcactcttgatcacaatatccagctgctcttttaaataattttttaatggatattcaaaaccttctgtcaagaaaaatatcaagtaatgttctaacagccagcaaaattcctcataactttgaaagcttctcccaatctttgcgatcttatatggaactttcgctggttttgtctcacacaaaacgatcttactcatgataatcacctctttccagctgtatgacctgctgccacgtctgatagcttgcctggcgaatctgtccaaacccaagatctgtgatcttgatcttacactgatctgctttgatgtattctccctgaattcttaatttatatacaagatttggatctttcttcattccgtctaatgacatacagatcgaagctttcttgattccagaacgatttctgacttcaaagatcaatccattcactcctgatacaaaaatttcaatctctccacggctttctttccatggctttccatccatgatcaaaggacagaacatatctcttccatggtgatgcacgaccagcccgatctgactgatcgtaacattttgtgcaaacacaacctcatctctggaaacatgtttatcattttcacataaatacactgctccacatgcaaacaaatgtttgctcataaatactcttcttccaaggcacaatgctttcgtagactgtttaaaccagcttccttcaaagccctctccacaaagataaactgtagccgtcacacctcttaccagtgcctgtttgatgatctgtaagaatgcgatatctttctcttcattcgccaccgcatccttgatctgttccgtataatccctgctgtcaaccaaaacacgatcttttgtcttgcggatctcatagcagataaatcgtttcttggtataatcaaaaatcactgaatttccacgcaacagattatctccacggaatccaacaactcccaacgctgcttcttctttggtaaaaaaacttaccctttcttttgtgattcctgcacggatacactgttcttctgcttgttgtacgatctgcggcgctgcttcatcaagaacaactccgatcgttccttccttttgtgcctgtgctgtcgaaatgacaaattccactctggatctgccataagtgacaggttcttcttccttaatctctccttgatctgacacacaaatatatgccagatctccttcaaaatgtattgccgtctgcatatcttattcctctgtcattggttttataaattgcaccatcattgcctttgctgcatattcctccatcatcatctggagtttttcatcctgctgatgccggatcagttcatttagttcataaaagcggcttcccttgcagtacttcaaatgatctgtcacgaccacctggtcacgatatcttctttcttctccttctatggttacataatggtcatttaattcatgatcaaatatagaagctgagaatacataatatccaggaagcagctctttcatcacttcctctttccatactgcacttgtcccatccataaaatggaatatcactgtctgcccactctttgcacgaaattctataaatgttctggcacaaagatactttggaagttttatcacatccagatattggaacaacactggaagaacatgatccgtctgaaccacctgatgatctttgatcttctcgatgcgtcctttacatctgtcacttaaattctcttttttatctttataataatcaagatagagctgctgatacatccagtccatctttccgatatcgatcttctttccgatcagttcataaaattcctctggaagtatctgatcttgttcatatgcaaaattcacatattctactaacatcgcatcgatcaatgccgtatctgtctgtacctgctgaatataagtagaaaataccttaaattctgttccatccacaccatctgcgatacaggcttttaacacactttccacaaaaatgcgatcatacataccacctttgtttcctgcttcaaatattgccagcatctcttccttggttccgtggaaatatctttgcagatatgcaacgatctcactgttttcctctccccttgagaatgcatattcacacatctcaaccaacagttctgagcgtctggtacttaatgttgtcagtgcatataagcagatcgtacacaattgctgcttatccaaaaactgatatccgtattgttcgattcctttcaaagcctcattatacaattcccctgctatgaaatagcgaatcatatgaattctgtttttgtcttttaagttcttccattccacataagaaagtgcacgtttcaattcttcagacatctcatgttcccagtaataatccaacactttttcaaataactgctgttcatagtcttcatccagtgctctactctttaatgcagataacacaactgggaagtcttcgtcttctaattgttgttttctttcaaaagctgcacctttatataggacaaaatgctcattcgttccgtctgctgcctcacaatatgcctggatctgctccttcgtccagattggttttaactgataagccactgatccaatgtatctgttttcctcactgtcaaaaaacacaaatgatgcatgttcgtcaaaaatctctacatagatcttttcttctcttaagtaacaaacatccagattcttcttccatctctgactaatctccgctttctggataaattcattgtcacagatcaactgtctgacaaaaataatattacctaaatcctgtcttgatctctcatcttccagcaattcttcaaaataataccggtataataagatcagatcttcattgatctgacctcttcttaattcttctcttaaaaaagctctgatcaattcttcataatttgcaaacaccttatggtattttcttctgttctgtacaacatttgcaaacagacggctttgatcttcttttccaagactcttactatacgtaaaatatcttaagatctcttctgggagcaatggatattgtcccttcgggatcgttcttaaaaaagcttcctgcaagccaatgagctgtactcctctttgaagtgcttcctcataataaggatgacagtcctcgtccatacaattgccctggatcatcagtgcacaaattccctgtagcacatcactctgacggtattctttataaatacaaaggaacaaccaaaggacttcttcggaaaacaccttgtttcttgaaattaaaaaacaaatccttccaatgagtttggaattcaggatcttctcctctgcaccaaattcaagcacccataattcataagaatcaatctcatccaacagttgttcatcttcgcctaaaatacagcatccttcaaattgcaagagtggattttgacatccttcctgatataattctttgatcaattccattcgaagtttagcatccttcatcaattcttcgcttagattcatataaagccagaacagatatcctttgatttttccatcttcgcattgatcatagagttctttaatctcatctcttgatcttatgatcgtttcttcttccttatcataaaatgcctgaagataccaaacatatccctgcgcgatcaaaagcggctctttcgatgcatcttctggaatcttttcttctaagtctccttttccttcaagaatagaaagatgcagtttcatcagatcataaatacgattcttaaccggatcatccggcatcttatcaagaaccatatttcctctctcataaagctgacttgttgtaatccttcctgtacagaaatccacatataattcgatcaatttcttttgacggaattcttcttctttttttctttcacttttctgttctttatagacaacctcgatctgcagagtctgataaacagtctgaatgatcagatggtcgatatctccatccttcggaattgttttcatatctgcatagatcgtcagagtgccatcttcaaaatcctctgcctgaaatacattcttgtgaagagacaggaaagttccgtcactttttattctccctaccagatacccccatccttctctcttgacttttatctccaatggttcatcaagattcatgatcgttgcctgatagatcgtctttgctgcactcaagagaaccggctttttctgtcctgaactcagcaaaaattcctccaagatctgattcctgtttctccccagcaaaagctgatgataaagctctttttcttctcttcgatcttttagatattcttctttaaacgcttcagaaaaaaagagtgtttttgcctcttttatatcttctttcacgatatttgtaaaattttccaatgattctgacataatcttattctgctccttgccaaccaaaagattttgtgggtataattatgatgtaaatatcaaaaatacaaattcaagtacacccatgcgtacttatcgcataatatgtattataccaaatttcgacacaatagaaaaggaaaagaggaattaccatgtcagaaaaaaaacaagaatttcacggaagtgatcttgagaaagtagaagcttattatggaatcaaaaaagaagatatcattccctttgccggaaatgtcaatccgctcggaatttctcctttgttaaagaaaagtatggcttctcatattgaatcaatcagcgaatatcctgaccgtgattataaagagcttcgttccacccttgcactttactgcaatgtcccaatggaacatatcattgttggaaatggtgcaactgagatgatcagtctgaccatgcagctgttacgtccaaaacatgccttgctgctttctccaacttattctgagtatacaagagagatcgatctggttggcggacatgtagaagaatattttttaagagaagatcttgattttaaactagatcttaataacctgatttcaaagcttaccgatgatattgatcttcttgcgatctgtaacccaaacaacccgacgtccagcgctttgaataccgaagagatcacaaagatcctaactcattgtaaattacatgatatcttcgttatgatcgatgaaacttatgtagaatttgcacctgatattgatacgatctctgcagtatccctaacaacaaaattcgataatttcatgatacttcgtggaacttccaaattcttctgcgctccaggactgcgacttggatatggaatctgtggaaatcttgctttccttgaacgtatgaacagtatcaaaaatccttggacgatcaatacacttgctgctcttgcaggagaagctatgtttatggatacagattatattcaaacaacaaaggattatatacaatctgaacgtacacgctgcattgatattttatccaaacgcgataacctaaagatttatccagcttatgcaaactttatccttgtaaaattattagatggcacaacttcttttgaaatgtttgaacgttgcattaagtctggcctgatgatccgtgactgtgcaagtttccatggactagacggtgaatttatccgattctgtattcagaagaaagaagataacgatcgtttgctgaatttattgacactctgatcataaatatttttataaaacaagaaatccctgagaatgaatcttttacaactcattctcagggatttctataactcatctatttattttactgcgataacttcaatctcgatcagtgctccttttggtagagctcctgcctgtacacaagatcttgctggtttgttatctccaaatgcttctttgtagatttcattgatttctgcaaaatcgttgatatctgctaagaacactgttgttttgataacattatctaatgtaagatctgatgcttttaatacagcacctaagttcgctaatacctgtttggtctgtgctgcgacaccttcttttaattcctgtgtctgtggatctaatccgatctgtccggatgtaaatacgaaatctcctgcttctactgcatgacaatatggtcctactgctgctggagcattctctgcattgatgatctttgtatccatcttatcttcctgcctttctctttggtcatttacttgatcactttaatcgatgggtaatacctaaaccatgcttttcctaagacttcatctctggaaacataatgggtctcccattctctggcatcatttgaattatttctgttatctcccatcacaaaatacccgttctttggtactttatatggtccaaaatcttctactggttcttctttgatatatggctcactgagtgctttcttacttccattaatatatactttaccgtcttttaccaacacagtctctcctggaagtgctatcacacgcttaataaaccattctgtctcatcatccggatatttgaagataatgatatctccacgtttcggatcgttaaaccaataggatgttcgaagagcgatcagtttatcattcgtcatgatcgtattctccatcgaaccacttggaatattcgcattgataattacaaaattcaagataaattctgtcagaagaatcgttacaacaatacatgcgatccagctaaatacctcacgcttgaaacttctcttctgttctttatctgcattttctttgctcatattgatctgtccttaataattaatcctcaaaaccacgtctgatgatatcatgtctttctggtccgttagatatcaaagtgatcggatatccaatcttctcttctacgaactcgatgtacttacggcagttttctggaagatcttcgtagtttttaattccacggatatcagatttccatcctggaagtacttctaatactgttttcgctttctcaagttttcctgttgttgggaaatctgttgttacttctccatcaatttcgtatccaacacatacaggaatctcatctaagtatccaagtacgtctaatactgtaaatgcaacatctgttgttccctgcatacggcatccgtatttggttgctacaacgtcaaaccatcccattcttcttggacgtcctgtagttgctccaaattctcctccatctccaccgcggcggcgaagttcatctgcttcatctccaaagatctcacttacgaaagctccagctcctacagcacttgaatatgcctttacaactgtaacgactttcttgatctcatatggagggattccggctccgatcgcaccatatcctgctaatgtagaagatgatgtaaccattggatagattccgtgatcagggtcttttaatgatcctaactgtccttctaataagatattctttccttctttgatcgcttcatgcaagaacagagatgtatcacatacatatggtgctaccatctctttgtattccattaatgtattgtataattcatctggatcaagaagtggtttatggtataaatgctctaataaaacattcttcttttcacatactgctttgatcttttcttttaaagaatcatcatcaaataattcgcttacctggaaaccgatctttgcatatttgtctgaataaaatggtgcgataccagattttgttgatccaaaagaattctttcctaaacgttcttcttcatactgatcaaataaaatatgatatggcatgaccatctgtgcacgatctgatactaagatctttggctgtggaacaccctgacttacgattccttcgatctctttgaataatacagggatatttaatgccacaccattaccgatcacactagttgtatggttgtagaataccccagatggtaatgtatgcaatgcaaacttaccatagtcattaatgatcgtatgacctgcatttgctcctccctgaaaacgaacgataatatcggatgtttcacccaacatgtctgtaatcttaccttttccttcgtctccccaattggctccaacgactgcttttaccatatgtgtatcctcctaataaaatcaattactttgactttttcttatattatttataatgctgttatatttaacaacatgacaacacgtttcattctatatcgttttgggcactctgtcaaggcagagtgtccaaagctttgatttattttccatcttttacactaaacaggtctgtacttacatgtttcttatccatcagactgttatactgtagatactgatactgtgtgatcagttttgtatattcattattctcagacaactcatggttctttccatctttatcaacatatccattggcatttaatgctgggacttcatttctcatatttaataagaactcattgtatcttgacatctttaagtttgtctgctgtaacatcaggcttgataaatagtttgcactgacattttccacatcgctctttgcatcaatatcataatttgcccagatgataaatggaactgtatatttcttctgcagttcttttaaacttaagctgtttagagattttccatataacagctcatagaaagaatcctcaagttttggctgatgatctccaaacattacaacgatcgttggctctttctgattcttaaagtagttgatgatcttctcgaatgctcgatctgattcatggatcagtgataaataacggtttgctgtatctgttgccttctcatctttgatcttgatctcttccttaaagttcttgtctgcgatcagatatccaccatggttctggatcgttacattgaataagaataatggctgtcccgcttttttcttattaaagatatctatgatcttattgtaatcttctgcatcactataccatcctctgaatttctctccatttggattcatagatgtctcatctaagaaattatcaaatccaattagcggatataccgtatctcggttccatccgtgtgctttgtatggatggaatgccagtgtatcatatccctgctgttttaactgagatgccagacttggcaccttatgttttacaaactgtgtatatgcatttccgtttaatggaagagatgatacagagtttcctgttaagaactcatactctgaattacttgttcctccaccaaaaacagataccagcatatgtcctttgatcgtattttcacttaaactattgataaatggcataacctctttgtttgtcttgatcttatttactacattcagatctgagaatgtttcattcatgatcacgacaacatttggtttctgttttaatttcttattggttccctgtgttacctgatacttatctgcgatcttatctaccgcttctgggctatatccatctggctgggaaacgatcgtatactgaatattcattaaaaagcttaaaatatatccattttttaagtatcctttcttctgttgccagaagtttacagcaacacctttctttgacaaaaagtctactcttgtcaagaagaaagaacttcctactgttacgattgctgtgatcagtaatgcaactagacgtttcttccaatggaagatcttatatgtatcgagtttacatgcaaacacacataatcccaataatacaaccgtcgcaacgattgctggtttatcataacttaatacataatgatctgcaacgtccattgctgttccaagtgcataaatatctgccggcgtgatcggtgttccacggaatgctaatacaaaatagtttccgatcgcagctgcatataaaaatacatctccaacgagcaacgcccatttcacacggttaaagatcagtaataaaatgaagaacaatatatagtaccataggatgttcattccaaatgccaatttattcatcacactgatcggattatagaatactttttctaccatataaaatgcgacccatggattgacgataaataatgcccatgtgaatctcttattccatttttctggaatctttaatggtgtaagaattaaaatgatcaaagcaagtgtgatcgctactgttaaaacaactgctgatacatcaatctgtgtcgtccacactctggttctaacatgaaaattcttctgtgttacaccatttaatttagctgactgatagatttttcccatattgcttgatgtatacagatataatgggcgttcggccttaataccctttcctgttatctcgatcgtataagtttcccctttattcaacttctgattcacgactactttgtaccatttattttcattacgcaaagtacgacgcatcgttgctttcatatctgtcagtccgtcaacctctaacagtgttggagtaatgtggaaaatagattttcctttactgtcttttacattcagatcaatacttccagctcttcctgtctgttcgtttcggtcgatcatgatatccaaccgttccatcgtatgtgaaactgctttaaatttctgaacaaccttatcaccatctgtcacttcaatcttcgtcagcttatgttctggtgttccttttgcaactttttcggaaaactggtctttgttcatcaaaaccaatacgataaatgcgatcaatgctaaaacaattccatatttcagaactttttgcatgacgctgtgaaatttttgtaatttcgtttcaccatttgtctgtgtcattttaccttaccttccattcgtttgtatttccccagttatttttcctttttctctctttttcattctctcttaaaaattccctaagattttgaaatctttggtttcttctttaattcctgcaagggaattacggatcgcaggatcatccagattcccgatcacatccacataaaatccgtattcccactttcttcctggaagtggtctggattcaatgttactcatactgacattgttaaacatgaaatgcgtcagaatattgtataaagatcctgattcatgtggcacgctaaaactgatgctgactttgcccgcatcttttctgtactgtttcttctttgacatgatcacaaatcttgttgtattatttccttcatcattcacctcacgtttcaaaatctcaagtccatacatctttgcagcacgttcactgcagattgcagctttcacaggcttattatcatctgctactttctttgcgctgatcgctgtatttgcaacttttacctgatcccagtctggatgttcatccaagaatcctttacactgcatcaatccttgtggatgagaatatactttttcaatcttatctaagctcgttccaggaattgcagccaatacatgctttacatctacagattcttctcccacgacgcaaatgtcatagtcaaggatcatatcataaattccactgactgttcctgctgaagtattctctattggcaatactccataatcagcttctcctcgatctagagtctttacaacatctttaaattctggtacagaaaaattcttgacatcctctccaaaatactgtaccattgcctgttcctgatatgcccctggaattccctgatatacaactttggtatcttcattgatatccaatgcttccacttcttcaaatgtctgatcaatataagcatcttcttgtgataacagactatactgatatcttcggctgatactcatcatctgaagaaacatctcttcgacagactttttaatgataagttcatcttcgtcttttgtcaaggcatcaattttctgtctttcacgaacaggatcataaattgcctttcctgttcctcttttatactctgcaacttctgcagaacatcccattctttctttaaataatgcaagcattttctgatcgatctgatcgatctgctgccttatctccgtcaaatctctcataagttactgttcctcttttatcttttcttttaattgcgtgatcgtctgtccaagaagcggatgcatcagatatggggcgatttcttctaatggttctaatacaaataatctcttgtgcatctctttatgtggaatcgtcagtcttctctcattcatcaccagatcatcatacatcaggatatcaagatctaatgttcttggtccccaatgaattgttctgactcttcccgcctgtgcttcaacatccatcagaaagtccaacagttcttctggctcttttaatgtgtcaatagcaatacatccattcaaaaaatcatcctgtaccacaccgccatatggcttggtctcgatcagactggaaacatgcacaactcttgtatcatcctgtgcctcgatcgcattgattgcctgattaatatattccatacgatctcccatatttgatcctactccaagatacgctctgtgccatcctcttttgatcttcactgaaacatagtcgagtggcaatccgatcggcgcccatggtttttttacttcaatctctagttttctgatcaatgaaaactcaagtaataatttcttcgccactgtttcagccacacattcgatcaggttaaagtcattttctgtaaggatctctttgatcctatgacatactttaccataatcaacggaataacccatctgatcactgacacctgcaagtttcgtatcaagcgataaaattgcagataccagaaatttttgcccaagtgctttctcttctttatacaaaccatgatttgcataaacttccaaatctttgattgtaatctgatccatcatctgttctccctattttgcacaaattgcttctatcatcttcattgcacgcatattttctttaacatcgtgaaccctgaaaaatctgcatcctttcatatatccactaaccgttgttgccacagttccttctactctctgatctgatggaagatccaacgttaaaccgatcatggattttctagatgttccaagaagaactggtacatcccactgatttaataactccagatggttcataagctctaaattctgatcaagatccttggcaaatccaattcctggatccagcatgatcgtttctttcttgattccagcttcctttgccatcttcatcgtctcatctaaatctgctaccacatcatttaaataatccttataatctgtatccttacggttatgcatcaagcaagaagcaactcctgtttctgctaaaactgcagccatagttccatcccacttaagcccccagatgtcattgatcagatctgctccagcctcgattcccgcttttgcaactcctgatttataagtatctaaggatactggcacatcaaattccttttttaatgcttcgatcacaggtgtgactcttgcgatctcttcttcatcagagatcaacgtgtatccaggtcttgcagattctcctccaacatcaatgatcgctgctccatctctgaccatctcatcagcatgctttagtgccgcatctaaatgatcatattttcctccatctgaaaatgaatctggtgtcacattcaaaattcccatgatgtatccatgatgtttcgtatcaaatgtcttatttccaataatcatagcatctctcctagtatatatacttgttgtttttcttttcttccggccaataacattcctgtcttgctttgcagtggatgcaatctcttgaaagtttatctgcgcgataaaagattgatgcaaaactttcgctttcttctttcatatctctatgccttaagatcgtatctgtcataaactttctctcttctctggtatatccacagtccgttaagatctcctcggcaagaatcgctcccgcttcctcgtgagaaattcccttttcatactgatcagctctcccaagatcatgaagcaatgcagtcgcataaatgatatctttggacacaggaagtcttttttcaaggatcatcagataactgattcttgccaccgacaaaaaatgttctatatcatgaccgcaaaactttcgatctatttctaattgttgtagtctctcgtatgtctccttgtatttctcatgccatacgatcttttggaatctttccactgtttctatcctctattttaattcattctgaaatgataatgtaccacagattatgatcacgtcttctttatctgcttgttgttttacctcttcaagacactctttcagtctctgtctttcttctacatcatgatgatattttcttacacattctgcaagatctttgcttgataaggccctcgcattatctggtgctaccgtataaacttttgctgccatcggcgtaaggatctgtatcatctgttcatagtctttgtctgataacactcccattatatagattaatcgtctatttgtaaaattattttgtaaaaaatttaacagacttttcgctccatccggattatgtgctccgtcacaaatgactagtgggtccttttctaagatctcgatcctgcctctccagattgttttgcgtaatccatcttctgtctgaaattcactgatacaataataatttcttatcgtattcaatgcttctaatgccaaggcagcattattgatctgatgtcttccaagaagcgggatttctatcttttcataccatcttccatcagatgagcgataagaaaagctctccccatttaaagattcacttaacacacggattccttccgaatttacaaaagtaaccttgcagtgcatctcttttgctttttccttgatcacttcgtttacggattcttgattgttatatgaaataactggacatccttcttttatgatccctgctttttctgctgcgatcttttctatcgtgtctccaagaaactgcatatggtccattccgatcgatgcaatgatcaccgcgatcggtttcttaactacgttcgttgcatcaagtctgccacccattcctgtttccaataacacaacatccacttttttatcgagaaaataaagaaaactgagtgccgtttcaatctcaaacattgtcggatgtgacatcccgtctctcaccatctcttctgaaattttctttattttttccatataaaagcacagatcttctttcgaaatgttctcttcattgatgcgaaatctctcttcgtagcaaaaagatgccggggagacatacctccccgcacgatatccactttctctgaagattcctgcaagaaatgcaagtgttgatccttttccattggttccggcaatatgaaccactttaagctgatcctgtggatttccaagtctttctaataattctttgatattatcaagtcctaaaacacttccaaatttattcgtattttgtataaaattcattgcttcttcgtaattcatcactgcctccagtttctatttccttcgatctaatgtacaaatgcttctttgatcacctgtgtcatagtttttacatagacgatctcaagtccttcgacaacttcctcttcaaactctttgacatctttttcatttgattttggaacaagtacttttgtaattccaagccgttttgctgcgagaagcttttcttttaatccaccgatcataagaacatctccgcggatcgtaacttcccctgtcattgccagatttccacagactttattacctgtgatcgctgacaaaacggctgttgtcatcgtaattccagcagatggtccgtcttttggcacggctccttctggaatatgaatatgtatatcatgtttttcaaagaaatcctgtttgatcttatattttctactctggcttctgatataactgatcgccgcctgtgcagactctttcatgacatttccaagggatcctgtcacctgaatcgctccttttcccggcataacatttacttcaatctttaatgtcaccccaccaacagctgtccaagccagtccatgaacaattccgacatgatctcttagagtgtctttttcccattcataaacaggtcttccaagataatctttgatcactttctttgtgatcgttacttttctgtgtttcttctggtagatgtctcttgtcacctttctcgaaacttgtccaattcttctctctaagtttctgacccctgcttctcttgtgtaatctgtgatcagaaatctcagggcatcttccttccagtgaatctgtgtatcatttaatccatttgcttccatctgtttctttaccagatagtcattcgcaatgtgatacttctcattctctgtataacttgatacctcgatgatctccatacggtcaagcagtggccttggaatcgtagaaaggtcattggccgttgcaacaaataagacatcacttaaattcaatgcaacttccagataatgatctgtaaaatgttcattctgttccgggtctaatacttcaagcagtgcagacgcggtatctcctctctggtctttccctgtcttatcgatctcatccaataacattaacggatttctaacttttaccttctttaatgtttcaacaatacgtcctggcatcgctccaacataagttttcctatgtccacggatctctgattcatccctgacgccgccaagagataaacgaatatattttttgttcgttgctttcgcaattgatctggcaatagatgtctttcctgttcctggaggtcctacaagacaaaggatcgctgcatctttctttccactcatagcacgtgctgctaaatattccaaaacacgttccttgactttttccattccataatgatctcgatcgagcacctgttgtgcatgatctaagtctgtggaatcttcgctcatctcttcccatggaacttcaaacattgtctcgatataagttcttaacacagagctttctggtgtctgatttcccattgtttgaaaacgcgatatctcttttttaagcttctctttgacttcatcggatgcttttagattcttaagtttctccataaattcatccgcttcatcctctacattcgtctctccaagttcctcacggatcactttgatctgctctcgcagcacatattctttctgatttttgtcaatattcactttgactttctgttggatcttctgcttcaatttcagaacatctagttcttcctgcagcatgacaagcattaattcacagcgctcttttagatccatttcttccaaaagtttctgtttctctggataagaaaatggaatatgtgttgcaagttcgtccaccagaatctccacatctgtcaataataaaatataatttactatattctgatccaaatgtggccaggctttcgcataaccttcaaatgcttctttgatcattcgaagaaatgcttctctttcaaattcctcaaatgactgttgttctacatgatcatataaaacctctactttatagaatggttcgtactcaacagtttcagaaagctctgcacgaaataatccttctgcaaaaactctcaaaatattctttggaagctttacaacctgtttgatccttgccagtgttcctacacgatataaatcttcaattcctggatcttctgccgtcggatcgatctgattatttaaaaagatcatctgatcatgttccatagcttcttcaattgcttttacagaacggcttcgtgatacatcaaaatgaatgactgtattcggaaatatatacttgcctctcagtggaagcattggtagtgtttttttcattcaagtcttcctttcatttctgaattatttgtctgtaaatttcgtcagacatgaagaaaaactgctttgacacaagaatctcttgcatgaaagcagtttttatttcggctaatctatctatgcaatctcaccatgattgcttgtctttacccgtttctttggcactgcggctttcaccttcactccagaatgttcgatcattggtttttctttaccttctacgacatcttttgtgatcaggcactctgatacatctgtctgtgatgggatttcgtacattaaatccatgatcacaccttccatgatcgcacgaagtcctctggcacctgtcttacgttctaatgctttcttggcaattgcaattaatgcatcatcatcaaacgtaagtttcacaccatccatctcgaacaatctctggtactgtttcacaagagcactctttggttctttcaaaatgcgcactaaggcttcttcatccaatggatttaaagatacattcactggaactcgtccaatgaactctggaatcagaccaaacttcacaaaatcttctggcaatacctgtcttaacagctcaccgagatctgtttccttctgcccaaatacatctgctccaaatccaatagatttcttgccaattcttgattcgatgatcttctctaatccgtcaaaggctcctccacagataaacaggatattggatgtatcaatctgaataaattcctgatgaggatgttttcttcctccctgtggcggcacagacgctacagtaccttcaatgatctttaataatgcctgctgcacaccctctccagagacatctcttgtgatcgatgtattctcagactttcttgtgatcttatcaatctcatcaatatagatgattccacactgtgcacggtcaatatcataatctgctgcctgaatgatcttaagaagaatattctcaacatcctcaccaacatatcctgcttctgtaagagcagtcgcatctgcgatcgcaaatggtacatttaacatctttgctaatgtctgggctaataatgtttttcctgaacctgttggtccaagcattaaaatattactcttctgcaattccacatcagagtctccacccattaaaattcttttgtaatgattatatacagctacggaaagtactttctttgcctcatcctgtccaataacatactggtctagaaattctttgatctcttttggcttacgtaaattgatctctccgtcattctctgcatactgttcaaattcttcttcaataatctcagaacaaatgtcaatacattcatcacaaatataaacattcttaccctttggtcccgcgatcagtttgcggacttggtcctgtgtcttattgcaaaaagaacatcttaatacttttttttcgtcattataacctgccaccagatcaccccactattctatcactatctattttccataaccttatcgatcaggccgtattccagtgcttcctgtgcagtgagccagttatcacgttctgtatccttgacgattgtctcgtatgactgtcctgtattctcgcttaagatcgtgtttaatttcttctttgttctaagaatatgttctgctgcgatctcaatctctgttgcctgtccctgtgctcctccagatggctgatggatcatgatctcagcattcggtaaagccagacgttttccttttgttccaccagataacaggaacgctcccatgctggcagccattcccatacacattgtggatacgtcacacttcacatactgcatcgtatcatagattgccattccggcggttacagaaccgccagggctattgatatataaattgatgtctttatctggatcttctgattctaagaataataactgagaaaccacaagtcctgctgtgacatcattcacttcttctcctaagaaaatgattctttctttcagcagtctggagtaaatatcataagatctttctcctctgcttgtttgttcaatgacataaggtactaaactcatccttgcatcctcctaatgatagttaaggcagtttatttatgtctgtcaaatagaacataaagttataaaatgccttgcttattttgcttcacctacaaggaaatctacagctttctgtactgcgatgtcatccatcatctggtctttctgagctccctgaatgatcttttcaagctgctctgtttccatctgatacattcctgccatcttttccagttctgctttgaagtcttcctcgcttgctgtgatatcttctgctttcgcgattgcttctaataccagacgtgtttcgattctcttaactgcctgtggttttaagtcatctgcgaatttctgtgcatccattccagagaacattaaatactgttccatagaaagtccctgatagcttaatctctgagcaaattcatctgtcatctgctgaacctgttcttcgatcatagcctctggaatatccattgtagctgcttctacagctgcatctacgatcttgttttctctttcagtattagctgcttctttctttctatcgcggatcttttctttaatatctgctttgtaatcttctaatgtttcaaattcagatacttctgctgcgaattcgtcatctaattctggaagttctttttctttgattgcttttactgttactgtaaatacagcatcttttcctgcaagatcaggtgcatgatattcttctgggaatgtcacgttgatatctgctgtttcgtttaaattctttcctactaactgttcttcaaatcctgggatgaatgctccagatccgataactaatgtctgatcttcagctgttccaccttcgaatttcactccatcaacagatccagagtaatcaattgttaagatatcgccgtcttttactgcacgatcttcaattgtgatctctcttgcgttctgttcctgaactttctttaattcttcttcgatttcgtcttttttcactgtaactcttgttttaggtacttcaattcctttgtagtctcctaaagttacttctggttttaatgcaaatgttgctgtgaagataaagtctttacctttctctaactgagtaacatcgatttctggtcttgaaacgatctctaaatctgtatctttcatagcttctgcataagcgtctggaattaagatgtttgctgcatcttcatagaagatttcaactccgtattcttttgcgatcaactggaaaggtacttttcctttacggaatccaggtacattaaactgtccttttttcttgttaaaagcctgtttgatagcgttatctaatttcgctgcttcaacttcaattgttacctttgccatattatgttctaagttttccacttgcaaactcatctgtatagatcctcctaaaaattattatcttttttgtaatttcacaaacattcacctattatagcataagatttgcgcgttatacaagcatctttgcgttatttttcacttttttcttgataaacatactcatttgaactgcttagtacccttagagccttactgacgatactcactttaaacgtatccccgtctttgagatctttcttcgatacctccaaaagatgttcattatggtaggttgtattgatctttacatcgccatcaaatacctgacagaaattcgtaaaattgtttcctacgataaagatgctgtcctttgtctcatatatcttcgtcaccgtaagcggccggattccaaattgaaggtccgttgccttaaatggattctcctgattccatacatactgttttccgtacaacatatcatactgaagctctttcatgtctttctgataattttttgtaccttttcttgtctggtgaaaactgttcattagtcctgtatggatattacacttattcagaacttctgatccaagatcatacgcctcgatcgttccgtccttcttcttcaatccaatattatcccacataaaataacttgtctgatatttatttccatatgtcagatcttcatcttcgatctccaaacttggaagatgatctccatacatacaaagaatcgttggttctccacgctgttgtaatgctttgaccagtttcccgacaaattgatccatctgataaacctgattgacataataagtatatttattcttcagtgcttcatcctcaattccttcaaccgtgatctccggattctcgatgatctgtgttgttggataatctccatgtccctgtacagaaatacaataaacataatcctgtcccttcgtagaatctagactatccataatacacccggtcaggatctgatcttttgcccatccattttctgtccatttcttgatgttcatactttcttttgttgtaaatgtatcaaaaccaagctgtgagaataccagatctcgatcataaaatgccgcactgttatcatggatcgcgtgtgccttatatccgtaattcttcaataccgtcgccatgctctctgtcgttgtattctgaagcactgttttatatggatattctgctgctccaaaatggtccagattcattcctgtgatcagttcaaactcagagtttgctgttcctgccccataagacggcatagaaagctgtccagaggaataccctttcatatacttatggaaatttggtaatggatctttgttaaacttaactcctttgacctgcgtaatatcaaaatgtgattccaactgtacaaagatgatatttggtttctttaccttttctttcttcatctttgcaaccttcttctgtgttcgtttctcaatctttttgatcttcttttctgaataatctgatggtttatcaattccattcttcaaggctgtaatactgaaacaatacggtgttccataatcactgaatgcaattcggatattatggatctgatctaccagcattccactcttaaatccataagaagtaactcccgaaaatactgctatgatcactataacttttataaatccgctcttacggtttaagtgttcttctattggaagatacatgtaagccactactaacaataccaatgcgatcagtaacaatgctcccattgctccaatctcaagtggcgagaagtaattattcataactggcaatacagacttcattaacgtaatatctacatacgtaaatggagtatttcttgaactgagcatcataaaatttacgattccaacgatactccatagcagtgttactattatataggaaaatagtcgtctcttagtaatcagtgtcacagagtatgttacgaaaataataaagatactatataaaaacatcttacttctctgatccacaaatcccacagcactaagatcaaatgtctgacgtcccaaaacttccaatacaaacgccagcacaactgacaatacaaaattacatatcaatgggtgttttcgaagcttctttacgatcgtatttccgatattcttaaaaaaagttttcatgcttttctcctttgctctttttcgctatcatagtattatatcattcaaaacagaaagtatctagttataacttcttaaatctttattaaaatgtaacactttcgcccaaaacttattaagtttttataaaataccacgttcttatttgacttcatagatattccgtgttaaaatcactaacgttaaaaactttgggttttgagtttttgacaaaatatgttcgaagggagttttacagaatttaagcgccatgcaccttcctgatacggaaacagaccgatgagggtctgataggaaggttaacgaggaggaaagtgatcgaaagattcggcggatgctttcccgcagctccagactacgtgatatactgagtaaacccatgagtgatcatgaaacagaggcagtataatctggacaaaaccgcatatgatttagaaaaagaaaacaaaagatttatttggaagtttttttacatatctatacttccttttattttctttgcgcaattttaaggagatttatattatgtgtggaattattggatttactggaaacttacaggcacctggaattttagttgatggattacagcagttagaatacagaggatatgacagtgccggaatcgcagtaaataatggatcagaaactaagatcgtaaaaacaactggaaaagttgcaacacttcgtgagaaagttgaagctactgctgaccttgctggaacatgcggtatcggacatactcgctgggcaactcatggtggtgttacagaagttaacgcacatcctcatgtatctggaaatgtaactctgatccataacggaatcattgaaaactacaaagaattagctgcttccttaaaaacaaaaggatttactgctatttctgaaacagataccgaagttgcagcaatgctgatcgactctttatatgatggagatccatttgcagcattaaaagaagctgataaagctttagaaggagcttatggtttctgtgttatgttcaaagatcatccaggagagatctattgcatgagaaatgcaagtccattagtagcatctcatacagaagatggttctttcatcgcttctgatatggttgcattattaaaatatacaaaagattatttcgtagtacctgaagaacatatcgttgtcatgaaagctgacagtattacattatacacaatggatggtggggttgaagaacctaagatgcttcatgttgactgggatacaacagctgcccagaaaggcggatatgatttctttatgcaaaaagagatctatgatcagccagaggctcttcataatacaatcatgcctcgtatccataatggtcacgctgactttagtgcagataacatctctgatgatatctttaaaggtgtaaaccgtgtgatcgtaacagcttgtggtactgcatggcatgcaggattagttggaagacatctgatcgaagctatgatccgtattcctgtaactgttgaattagcttctgaattccgttacatgaatccgatcttagatgaacatactttagttgttgtcatcacacagtctggtgaaacagctgattcccttgctgcacttcgtcttgcaaatgaacgtggagcaaaaacgatctctatcgttaacgtaaaaggatcaagtatcgctcgtgaaagtgattatgtattatatacacatgcaggtccagagatcgctgttgcaagtacaaaagcgttctctgtacagtgtgcaggtatgtatctgattgcattaaaacttgcagaagttaacaacttaatgacagatgaacagatgaaagatttctgtgataaatttgaacaggcgatcggaactgttgaagaagtcttaaagatggatgattatatcaaaggaatctcagaaaagatcaaagatacattctctgctttctatcttggaagaggattagattacggtattgcttgtgaagcctgcttaaaattaaaagaaatctcttatgtaaatgcagaagcatactgtgccggagaattgaaacatggaacaatttctctgattacagaaggtgtacctattattgcgatcgctacacaggaaaatgtcttaccaaaattaatggcaaacgttgaagaagtaaaagctcgtggtgctcatgtgatcgtagtaacagataaagatatgagcaattacgaaggaatctatgatgatttaattcaggttcctgcaacagacgatttatttgcaacatttgcttctaccgttgcattacagttacttgcttatcatgtcacagtattcagaggatatgatgtagaccagccaagaaacctggctaaatctgtaactgtagagtaggcagacattaaaaaaagatgcgaaggaattaatccattccctcgcatcttttattttctttccagtcaaaacagatacataaatccaaaacgaaatcactgccattacaaacataacaatacactgtaaaatttttatactattttttctttcttttatctttttaactttatattttctttctataaacattattacaatccataaaataatccaaataatgctccataccacaaattgtttaaaaaagttattcggaaaaaatatttctatttcagcgcctttcatatacttcaaagacatttttataaaataccagattccagccactggcatcaacaacattactattaacactattaatttctttttatctttcaaaatgtttctccttaaattaatcttccaataactattattttgatatcatcacaaatctagtgccaactttctttccagattctgacctctcatttccaaatcctattcctgtaccccatttgctgccatccattctggtaacaataatttttccgcttcctatatgaacagttgccacatctcccattacttttttaggtttaaaccaacattctttattagaatctccaaaataccaaccagccttctttccgttacccaattgtccataggtattatctccccacaaatatagattattttttccgtaatcacagccatattatatccacctgctgcaatatattttacattttcaaatattttcttaggtttacaggaaattaaatccgtatttttatcatatcctaacattccgcctgcattacttccccatgtccatacagaatgatcttttttcatagcaatgaccgctcctccttcattgatggaagcataaataatattattcataataaaaacaggttgacgaaaaactgctgtacttacattatttcttttatcttctggcattttaatctgaaattcttcatcactattccaccccattccatataatctgtttttataatcaagatacaacagacttcctcttcctccaaaactaatatgttttacattatgcgcaatcgtatctttcattacatgcccatattttttcagtggatacccatattcatcgattagtgttccatacaatttcccattctttttaatttgatactcgtacggcattcctttaattccagaagaacaaagaatctttttgttataatgatcttctagtttataagatagatatttcagttttttatatcttacagactttttataatctttttgtatcattgcaccagatttaaacaacccaataattccaagagctactatgatactaatcactattacaatgaacacaatcctatttctcttgctttgtctcatttactttcccctctttcatatgttttttcttaatataataccaccctttcatacaaataaaaatccaccttgcgtatctagtcattttttatgctcaaatggttatattaaagcctttacaaaatataattttgtattaaaatatattattagagaaatttgataaaaggagatcaacttatgacacttactatattactaacccttcttggaacctctattgacacgattttattatgctattgtacaaaatattttaattttcgatattcgtacataaaatcaggtatcctttacacattatggggtctttctattattcttttaaatttactttcttgcccatttatttttaaattaatctatgaattgttttccatcatatttttaaatcgttacttatatttggatttccaattgaaatctactttaaaaatgatcgttgtattttatattgttttatgtttatgtgaattattaactgttggaatttgttttagtgttttacattgcacatctttatccgatatttttgataatcaggttctttcattggaaatgatcattttttcaaaaattttatccctcttattattacattttgttttttatcataaacaaaacgatatagagatttcttttacaccaatagaaagtattctttattttcttccgatcatcacatgcttacttctcattttaggcattatatatttgttgaaaatttctaatatttcttcacaatatcatgaagtctttttatggatctctattgtactaatgatcagttctttttgccattttatattattcaacctgtacctttccaaaaaggctgaagaaaattatattaattttgtaaaatcacaagaagaaaaaactttttattattatcagcaaaaacaaaaggacattgaagatttaaacattatacgtcatgatcttaaaaatcagcttttagccttaaaatcacagccagcagagagcaatcaatacacacaacatattgattccttactgaatgatctttcaaaatcttcctatgctatacacacaggaaatccttttattgatgttttaatttctgagaaattaaagctgatccacgaacaacacatttcttgcaaaatgaacgtagaattagagaatattcattttattcgtaatatagagttatgttctttgcttggtaatttgttggataattgcattgaagctacccaatgttgtgacaagaacagaagcatcaccttttgctgtaatacgacacaaaatcatttttgcattcatgcatccaatacatataataaaaaattaaaatataaaaacggctccatcataactacaaaaaaagattcttctatgcatggttttggaataatttcaatcaaaaaaatcgtttccaaatataacggaaatgtctctttttcttccaaccttgaagaatttgttgtaaatatttccataccactcccacaaaacctgaattaaatataagagaggaaaacattatgaaaatctgtatttgtgatgatgaaaaagactttattcacaattttcaattacttttgaaacagtattctaaaaagcacaaaaatatcaatcaatttaactcctttgaaaatgaaaatgatctgttatcttatttttattctcaaaatgatattgacatcttatttttagatataaaattccaaacctatagcggaatagaaattgctaaaaaaatacgagatattaatccatccgtaattttaatctttttaacttcttttccagaatatgctttatctggttacaaagtaaaagcttttgattatcttgtaaaaccactttcatatctgcaattggaaaatgttttggaccaagctatttcagaacttaaatctaatgaaaagcattttttaatcataaaagattcaggaaatattttcaaaatcaaatttcctgaaattatatacatagaaacttataaccgaaatattttatttcatttaacatccggatctgaaatcactggacatgaatccttaaaagcatacgaagataaacttgatgaacgtttttatcgctgccatacaggctatattgttaatatggcatatgtaacttctatacaaaaggattgtgctatattaaattctaatgtcaccgttcctgtcagtcgatataaaaagaaaaaattccaaatgttatttactgattttttgtgtaattctattttttaatttcaaaaatcccctgaaaggtcgatcaacctttcagggggatctcatactttacatatctatacttatgaaataatcagcaattctactcttccgtataatatctgcccaaagcatccgcacccatgatcgcagcatacagatcttctggttgcacatcaaatggcatattccccattgtatcatctggtgcacatgcaagacgtgccacttccatgatctgctctggtttcacttcctcgattcctaatccttttaatgttacaggaagtccaatttcactgcagaaatcaatcacttccatgatctcatcttctcccgcatcttctaataccagctgaaccagtgttccgaatgccaccttctctccatgatacatcttatgtgtttctggaatcgctgtaaatccgttgtggatcgcatgagcccctgctaatcctccactctcaaatccaattcctgataaataagtattagcttcaataacattctccacagcttttgtacaaattccttctttagctgctatcattgcctgtactccattttccatcaatgtatcatagcataattgagcaagattcattgctgccaatgtacatttacctccaacacagttacttgcatcagatcttttacatgctctcgcttcaaaatatgtcgctaaagcatctcccattcctgagatcaacagtcttactggtgctttacagacgatatcggtatctaccatgaccatatctgggcttgatggcaagaacagatatttttcaaaaacaccttcatctgtatagataacagataatgcactgcatggtgcatccgtagatgcgatcgttggcacgatgatcactggtttctttgtataataggcaaccgcttttgatgtatcatgaatcttaccaccgccaattccaatgatcacatcacttcctgcttcttccacaatctttataattcggttgatctccgtcatacagcattctccattgaacacatcataaacaagattgctgtctttatttccttcattgatcgccggttctactctttttcttccagatgcactcgtcagaataaagagattctttccaaatttatctgcataagaacaaagattcttcatctctcctttaccttgaatgtagcgtgttggacttccaataattgctgccataatatttccctccatatcaactctatttctcatcatgataccatggtcaaaataccatttgatatcaacatctcgttattattataacactctttttgttatatttaaacataaatatatttatattcattctttttttatctgtttttacccgtaagtttattatttttttatttttcacgttaatatattgtcaaattttcgtttagattttttctattttcttgccttttttatcatttttccatatacttatacatactgaatacaaaatccgacaaaaggagacatttacaaatgatgatcaaaactttatttttgctaagctttctcttctttatctactcatttatcggctggatcttagaagtggtacaatcagcatttcatcagaaacgtttggtaaaccgtggttttatcaactcaccgctttgtatttcctatggaatcggagctatcgttattacgatcaatacgcatcagatgaccggcctatggatctttgctgccgccatgatcgatgccacagtcattgaatggtttggcggacattttattgaacatttttaccatgaacgctggtgggattattccaaaaataaatggaatcttgatggctacatctgcctgtcccattcggttttctggggacttttaggatatatcggagtaaagtttgtcaatccactgctctttaaattttatcatctgatcccgccatttatccgacatcttatcatttttatccttcttgcagtcctgatcattgatattttagcaaccacgatcgttgtctttggaaaaaatatcgataaacgacgttgggaatctgcggatgcttatcttacaaagatcagcgtgaaattgagttcgttgataacatcttatgtggatcgtcgtgttgaacatgcttatccacagcgtaaattaaaactgccaacgatcccaaagactggtgtatttgcccagggatgcggtttttataaggtgtttttgttattttccatcggttctttgcttggagacatcattgaaacgatcttctgtcgtttgaagatgggcgtctggatgagcaggagcagccttgtatggggtccttttagcattgtgtggggatttgcctttgctggtgttacattgcttctataccgctataaagatcgttcagacagctttctatttttaactggtacttttcttggcggcgcctatgaatatctctgcagcgttttaagtgaaatcgtctttggaaaggttttctgggattacagtaaaatgccttttaacttgaatggaagaatcaatcttctttattgtttcttctggggaattgcaaccgttgtctggtttaagaggatttatcctttcttatccaatctgatcgagaaacttccgattgcatttggaactgtatttacatggatcattgtcgttttcatggtattaaatatgttcatgtcactatctgccttgatccgttatgatcagcgtaacaaaaaaatacctgcttctaatttctttgaacgatatctggatacccattataacgaccagaaaatgaaactcatctatcctaaagcaaagaaagtgcattgatcgaggtacttttacaaaaacttctgatgcagaaaaagggaatgaaactaacattttgttgtttcattcccttttcttatcttttctttaaaatatgatcctatccgatcacatcactcatatcatacatacctgcttcttttcctgcaagataaagagctgcactgactgctccctttccaaaaatagctctgctgtatgcagtatgttttaactcaataacttcatcctgtcctgcaaaaatgatctcatgttctccaacgatcgttccaccacggactgctgagattccaatctctttctttggacgctgttctcttctctggcttctgtcatatacgaattcatattcgttattcaacggctcattgacagcttctgcaagcgcgattgctgttccagatggtgcatctaactttcttctgtgatgtttctccacgatatcaatatcaaatcctgcatctgctaataactttgtcatagattttaatactttgaataatgtgttaactcctaatgacatattcgcagaacgaagaactgctgtcttcttacttgcttcatgaactctttctaactgttcatcgcttaatcctgttgtacataacacaactggaatctgtctctctactgcaaaatccagtaaaccatcaacggctggtgctgcggaaaagtcgatgatcgcatcaacttctacatcacacgcattgatatctgtaaatacaggataatcgttgtgcccatcatccacacggtcaacaccgcatgccataacagctccttctgtctcttctacgatcttgctgatcacctgtcccatgactccattgcagccatgcatcataatcttaaccatcttttgtaactccttaaagaattcctgcttctttcattgactgaattaatacctgtgcgtgatcctcttccatctctgttaatggacgacgaacgatatttttacaatatcccatctctgctactgcacgttttgcaggaattgggtttacttcgctaaataagttatggatcacatccatgtattttaactggatatctaaacttcctttgacgtccccttctaagaacttcattaccatatcatgagtttctcttggtgctacattggataatacagagatgacaccttttccacctaatgctaaaagaggtacaacctgatcatcatttcctgaataaatatctaagcatccgtctgctaatgctgcaagagttgctacctgaccgatatctccgcttgcttctttgatcgctacgatattatcaacactcttcgcgatcttcactgctgtagctggctggatgtttgttcctgttcttcctggcacattgtacatgatgattggaatgtctacagaattaccaactgttgtataatattcttccaaacctttctgtgttgctttgttatagtatggtgttacgactaacaatccgtctgctcctgctttctctgatctcttggcaaggttcagtgcttcatctgtgcagttcgctcctgctcctgcgataactggaactcttccattgacatgagaaacacatgcactgactacttcgatctgttcgtcatgagacattgtagaagcctctcctgaagttccacagataacgatactgtctgttccgttatcgatctggaaatcaataaatttctctaactgatcataatccaccgataaatcttctttgaatggtgtcactaatgcaacacctgcacctgtaaaaattgacatttttctttcctcctatcatcctatgtagcatcaacattaagattctttgatcgtactgatctcatatactgcatctgcatacggaatcaatgcttctggaatctgccgtcctgtcatgatgatcgtctggtcatcactacgattttctaacatctccaccagttcttcggtctttaatagtccaagatccaaaagtccaagcacttcatctaaaacgaccatgtcgcactgtcttgtatctatgactttatgtgcatattttaatccattataaataaaatgatcttgttctttcttctcttcttcattcagatcctcatacaatctctcgtacttttcaaaacgaaacaactgtacttctggttctaaacgtttgaaaaagcttaattcttcggtctcctttcctttcaggaactgaaccataatgatctgcttttcctgcccggctgctttcacacactggccgatcgcacaggatgtcttccctctgccctggccacagtatatttccactcgtccttccatcttttcacctcaaagaatcttccttttgtagtaatatatttggtttaggatattatatcatttctgatactataaatacaactattcttcatccttttcatgaaactccagtttgtttactgatacctcatatgcaactcgtctgatcagttcattttctgaaactcttttctgatattctctgctttgaattcttccgatcagctgaattcttgaaccgatttcaagattccctgcaaatctcgcattccttccccagcagatgcatggtatgtagtcggatttgccataggaacggttcactgcaagcaagatgtcacaaatctctcttcccagcggtgtcatccgatatactggctgcttacagataaatccatctaaaatgatctgattcggtctgactccatccatgctttctataaattccagatccctgacgaatacagataagatcaaatgattacgattctcctcgtgcttgttgaaggaacggaattgaccgcaagctcttacaagcattcctttgtaatcttttgtcacatcaacgagcctctctgatattaataatggtatctcgtctgttgcttcacttaatctgtttactaaaagtttgactgtataaaatccttctccgaaaatctcatggctgtattcaaacgctgaattgatacgtccgcaaacctccacttgattatgattgattccctgctctgtcatactctttctcccttcttgtgttctattagtatactttaaatcgtattccaattttgacacaattagaagaaaaatccttcgacaaagttagtcacactttttcgacatgttttaaacggctttcataccgtgcatgatcttatgagaattttgcacgttttctcattgttggatctaagatcttcttgcggatacggatattctctggagtgatctcaagtaattcatccgtatcgataaactctaatgcctgctctaagcttaagatctttggaggagataattttaatgcatcatctgatcctgaagcacgtgtatttgtaagcttcttgctgcggcatacattgatctcgatatcttctgttttaccagtctgtccgatgaccattccaccgtatactttctcaccaggtcctacaaataaagtacctctctcctgtgcattaaacagaccatatgtgatcgtttctcctgcttcatatgcgatcaatgatccctgtttacgatactggatatcccctttgtatggtccatatccatcaaacagtgtatttaagataccatttccttttgtatctgtcataaattctccacgatacccgatcagtcctctggatgggatagagaattcaagtcttgcataacctccattggctgctgtcatattctgaagttcaccttttctctggcttaatttctcaataactgcccctgtaaattcttctggaacatcaatgacggcaatctccattggctctaatttcttaccattctcgtcataatgatataatacttctgctttactgactgcaaattcatatccttcacgacgcatgttctcgatcaatacagataaatgtaattctccacgtccagatactttatagctgtcctgattctcactttcttccacacgaaggctgacatccgtattcaattctctgaacaatctgtctctgatatgtcttgatgtaacatatttaccttcctgacctgcaagagggctgtcatttaccataaactgcatagagatcgttggctctgagatcttctggaatggaattgcttctgctccatccacatcacagatcgtatctccaattgacagatctgagattcctgagatcgctacaatagatcctacctgtgcattctttacatctactttatcaagtccttcaaattcatataattttgtgatgcggactttttctttacgttctgggtcatgagcattcactacgatgcattctttgttgaccgcgatctcaccattatctactttaccgattccgatacgtccaacatattcattgtagtcgatcgtactgatcaatacctgtaatggtttctctggatcaccttctggtgcttcgatatgttcaatgatcgtctcaaataatggtttcatatctttcttctcaccatcaagatctaatgttgcgaatccttctttggctgatgcaaatacaaatggacagtcaagctgtttatcccctgcatctaattccattaatagttctaatgtctcatcgacaacttcatctggtcttgcttctggacggtctactttattgacacatacgatcacagacagatcaagctctaatgctttctttaatacaaactttgtctgtggcattggtccttcaaatgcatcaacaactaatacaacaccatttaccatcttcagtacacgttctacttctccaccaaagtcagcatgccccggtgtatcgatgatattgatcttgattccattatacataactcctgtattcttagacagaatcgtgattcctctttctttctcgatgtcatttgagtccatgactctctctgcgacttcctgattgtcacggaagattccgctctgttttaacatctcgtctactaatgttgtcttaccatgatcgacatgggcaatgattgcaatatttctcacatcttcgcgcttcatttatatccttctttctagtatctttctgtatcagtttccatggcatttataaagcatgccaagattaacttttttattctatcacactcaatgaaaagttgcaattttattattttgtaccaacgatattctttggcttttcttctattatatgttatatttcttatagaccagaaaaggagttggacattatgaatttacacgaactaattgatcgtttgcataaagagcatacattgacaaaagaagaatttatcacacttattaaagaacggaacgaagaaagcgcatcttatcttgcctctcttgccagagaagaagctgtaaatatctatggaaatggtgttttcccacgtggattggtagaatttacgaattactgcaaaaataactgctattactgcggaattcaaggcagcaatccgaatgcaaatcgttaccgtctgtcaaaagaggaaatcctttctgcctgtgagaatggttaccagcttggatatcgaagctttgttcttcaaggcggtgaggatcctcattatacagatgaagttatggttcctatcgtggcagagatcagaaagcgctaccctgattgtgccatcacactttctcttggggaacgctccaaagaaagttatcaaaaattatatgatgcaggtgctgatcgttatctgcttcgacatgaagctgctgacccagagctttaccagaaactccacccagaaagtctttctttagaaaaccggatccagtgtctgtggaatctaaaagaaatcggctatgctgtaggaactggatttatggttggagccccttatcagacggttgagaatcttgcagacgacctgctatttatcaaaaaacttgacccacagatggtcggaatcggtccttttgttccacatcacgatacaagatttaaggaattcccttctggaagtgtagaacttaccacataccttgtgagtattcttcgtctgatgaaccctcatcttttgcttccttccacaacagcacttggtacgatcgatcctcgtggaagagaaaaaggaattcttgcaggtgcaaatgttgttatgccgaatctttctcctgttgcagtaagaaaagattattctttatatgacaataagatctgcactggagaggaagctgctgaatgtgctggctgtcttggaagacgtcttgccagtattgattatcagcttgtattcagccgtggagattatatcgaataacctgcttatcagcagttaagaaagaatccttgcataggggattccatcggaatttcctatgatataaaaagcgtgtagaatctttgaaatcctacacgcttttattctgtcttttatctgttaagaaattatcttcttctgctctttaataagaactctggaatgttgatcttagagctttcctgttcgatctctttcatctcaggttcagaaacatagcttgttgtctgtactggctgttcttcctccatgacctttccattatgtaatggctgccctgaaaattccggagcctgctgtgtctgctgtactggcttcttcgctgcagcaaatccagttcttgcattccctgtaatatctgcggatttgattcctgttgcgatgatcgttgcactgatctgatctccaaaatctgcattgactgtaccgaagatgacattgacatcgtctcctgcttcgtcttttaagtattccacagcctgctgtgcttctaacattccaaccgctcctgcgaagttgacgatcacatctgtagctccagcaacagttgtctcaagcaatggactttccatcgctgtcttgattgcttcaagttcttcgtctgcaacacccataccgatatgtgcaatacctttatctctcataactgtctgaatatcagcaaaatcgacattgatcaatcctgggttgtagatcatatctgtaattccctgtacaccctgctgcagtacttcatctgctttcttcagtgcatctgggatcgttgttctcttatcacagatctgtaacaacttgtcattcggaatgacgatcattgtatccacctgatcctgaaggcgtgcaattcctgacattgcattgttcatacgaggctttccttcaaatgtaaatggttttgtcacaactccaactgttaaaattccaagtcctttggaaatctctgcaatgatcggtgctgcacctgtaccggtacctccacccattccacatgttacaaataccatatctgatccctgaaccaattctgtgatctcttcacgattctcttcaaccgctgcttccccgatctcaggttttgctcctgctccaagtccctttgtcagtttctccccgatctgaatctttgttcctgctttacataaagataaagcctgtctatctgtattcacacccacgagttcaacaccctggacattctcatctaccattcggtttaccgcattgtttcctgctccaccgactcctattactaaaatccttgcttgtgtgttctcaacactaggcataatctcaaccacgttgttcctccttcacgccatctatgttaaaatgactcccttaaattctgtacactaacttaatgataccttctttactaagttttttcaactcttttttggttgaaaaacagcaattttgtggtcctcgctaaagtacttcatgtcaatagttccacttttcccttttactttcttaagcatccctgctaattcagaaatcttgatatcaatatcctttttattataaagatcaaccgttatcttatcgctgatcaataaggcatttccatcttctttgatataaatctgatcgatcggaagattatatttatcaattgcagtcgtaagttctaaaagataagaaaaaactttctctttcttgactggaatcttctcctgcatgaccaattcatcatatttaagtccagtaaccaatggaacatcgtcatatttcttttcataactttccaatgcataaccatttttatcaaaatagacgtattttccattatacagaaggcatccagccctctttttttcttttacctcgaccgtgatcgtatctggccggttgatccttacatgaatcgaatctataaatggcagaagatctggtgacgcaatcttacattttaagaaatatgcaaccgagttatcaatatatccattctctacaactgcctttttaacttctgcttctgtataataacttaatccagaaattttgatctgttttgttttacacgtccctgcaatgatcacaaccgtaaggatcaaaactgcaacgataccaagcagtattttcttccccgatagtttatgtactttattcttgtttttatgctcatccatacggatgacttttttttcttccatcacactcacccttatcttatgtgaattttcttagaaattgataatacgattcccatttcgatcatgacaacgaggatcgatgtacctccataactgataaatggaagtggaattcctgtcggcgggatcgtgtttgttacaacagcaatattgataaatacctgaattgcgatatgtgtcataaaaccgatcacaatcagtgatccaaataagtcttctgtattcagtgcgatcaagagcatccgaaagatcagtgccacaaacacaaggatcagacaaactgccccgaacaatcctaattcttcacaaatgattgagaagatcatatcattgtgtgattctggaataaatcccatcttctgcatactctgcccaagtccttttccaaaaatcccaccggaaccaatcgcatataatgcctgcatcgtctgaaatccctttttgtgactttctggatgcagccagatctgtacacgctcgtttcgataactatttgccgtcaacagatacacgaacaagagtattattccaccgcctgctgttaacataagttctttcatcttcggacttaccacaaacagcatgacaccgatcatcgaacacacgacaagtgctgtacttaagttctgtgtaacgatcagagcaatgatcgggaccgttggaagaacgatcacgatactatctttgaatgttcggatcttatgagcatttgctgataatctgttcgcgagatagatcacaaccaggattttagatacttctgatggctgaaactgaaatcctgcgatgctgatccagcggactgcacccttctttgctgcacctatgatcaacacaagaactaacagtacgatactagcccaataacagccatttccaaccttctcactttttatgatgcggtaatctagtttacagcatacaaccattgcaaccgcacctaacactatcgcaactgcctgccttaacagccagtgataggaatttccatatgtgacagtactcttatatgaacttgtactatagatcataaccagaccaaaacatatcagaaatattaccagaaacaacatcggataatcaaagtatcttttgccggccatatatttttctttgatgcgatttgccactttttagttctcctttaattttctgacacaatctttgaagatatctcccctgacttcataattcgggaacattccccagcttgcacatgcaggtgataataaaactgcttctccatcttgggcttttcctgcaatgtatgaaactgcttcttccatagaatcaacaaacttgatcttatcaaatccatgtgtttttgcacaatcagcgatctttggtgctgttacacccatcaagatcagttctttaacttttccgtcaaatgcttcgatccactcatcatatgtagatttcttgtcatatccaccaccgatcagccatgttgggcggttcattgctttgattcctttgatcgctgcatctggattcgttcctttagaatcgttatagtatgcaacacctttcactgtatccacatattcaatacgatgttctacacctttaaacctcttgattccttctttgatatatgaaactggaactcccatagaataagtcactgcgatcgctgctaaaatattttcataattatggtctcctaacagattcacatcatctaatgtacatacgatctgtttctttccattttcttcgatgataaatgcatcaccttccatggaaaccccttcttttattttatgatgcaaactgaaaaacagaactgttccattcgctctgtctgccatagctcttgttgtatcatcttcataatttaataccattacctggtcttttgtctggttttttccaatggattcttttgtctgtgcataaacttctactgtaccatgacgatccaaatgatctggtgtgatattaagaactgcacatacatccggtttaaaatcaacgatcgtttctaactggaaactgctgatctctgcagttgttacactgtcctcttttgtatcaagcgcaacacttgtataaggaattccgatatttccgacaacaaaactgctttcataatatcctttcatgatctctccagtcagcgctgttgtcgttgtctttccgttggttcctgtgatcgctgcgattcttcctttggatgcctgatatgctaattcaatctcactccatactggcttttcctgatcacgaaacatctgtgcgatcggtgcatttactgaaatcccaggacttaacactaatagatcgaacttacttacatcttcttttgtgatatttcctaagatcaatggaatctctttcttttcatataatttctcataaagtgcctctttctcaaggtcttcctttccatcatacagactgacatctgcacctgtttttaaaagcagattgacagaaccaattccactttttcctgctcctgctactaaaaatttcttgcttgtatctatcatttctttctccttactaaatcgctaccagtccgatcaggcaacaaactgccgtggtgatcgcaaagattgctacaacctttgtttctggccatcctgacaattcaaaatgatgatggatcggtgccattttaaataatctttttccttttgtcattttaaaatataatacctgtgccataacagataatacctcgatcatatagatcaatgcaacaattgggataaataaagacaggcgaagcatcaatgctgttgctgccacaaatcccccaagtgcaagcgagcctgtatctcccataaacactctcgccggatatacattaaatactaaaaaaccaagaagtgagccaaccgtcgcacaagataccggccagattccagctgccagatcattatgccccattccaatagctgccactgtaaaaaatgttgcgatcaataccgtaacacttgatgcaagtccatccaatccatccgtaaaattagctccattcacagttcctaacaaaatgataaaaaccgctgggataaaaaatactccaaggtttaaatatttaccatgtgtaaaaggaatcagcatcgaagttcctgtctgcgtgtaatttatcaaataatacgcaaagattcctgtgactatgatctgcccaaacatcttctgccaggcccgcagtcccaggttccttttcataactaccttgatgtaatcatcgataaatccgataaatccaaatcccagcgtcacaaacagcaccgggatgatcatcggatatcttctaacataaaataacgatgcgattacgattccaagtaatatgatcagtcctcccatcgtcggagtccctgatttcttcagatgtgattcgggtccttctccccggataaactgaccgaattttaatttgtgtaaatacctgatcatcatcgggctaagaagtacgctgataaaaaaggcaattaaaactggttttacaataccataattcatgtcgccacctcatttgttcttgtttcgtctacggttcttttttatctggcgtatattctttataaatccccatgtatggaagtgcagtttgaaacacacttctcatcacaggggctgcgatcgttcctccatagtaagttccatgtggttcatcgatcaacacgatcccaatgatcgcaggattgtctgctttcgcaaatcctaaaaaagaagaaatatattttccatttcctcttggaagtttctcactggttgccgtctttcccccaatggaaaaaccatccatccggcagtttcttcctgatccatcggaaacaactgcttctaacaattctttcatcgtctccgatgtctgtttttttatgaccccttctttcactgaataaaaagcttttaatcttgttccatcctgcttctgaacatatcttccaaaatgcggtgtgatcagcttcccgccgttgatcaccgcactgactgctcttaacagctgtaacggtgtgatctgtatggactgtccaaaagacatcgttgcaagttctactgcaccgacattcttcttttgatgcatgatcgaagatgcttctccaggaaggtcaatccctgttttctcaaacagcccaagctggcggaatgtctgatacattccatccacaccaactctggcaccgacatccataaatactggattacaggaattcataacaccttctttaaatgtctcacttccatgtcctccgactttgtgacaccggatcttgcgatcctccacaatccgaaatcctggacaattaaaatgatcattcacgctgactttcgatgattccagtcctgcagtcgccgttacgatcttaaagaccgatcccggttcataagtatcatttaaacaggaattccgccacttcttattgagatattcctgttgtttcttactatttgcctttcttttctttgctgacaaagaaaaaggatcattcagatcatattctggaacattgaccattgcatagatttctccattctgtggattcatcaagatcatggatacctgttttgccttcttctctttcttcaccttcttacatgcctgcacggcataattttgcagattcacatcaagcgaaatataaagatcccctccggcaactggttcttccctctcttcatatgctccatcgatttctatgccacttccatctgtcagtgtccggatccttccggactttcctttaagatattgatcataaaaaacctccagtccaatgattccctggttatctcctcctgtaaatccaagaactttcgatgccaggttattatatggatatactcttttgtaatcttcatccaccttgaccccatcaagtttaaacttacggatacagtctgcgatgtctttttctacattacttttaattttttcccttactgaatttttatatactttttttcggatcaaagattctttgatcttaagattctcagataagacctttattactttttccctgtcggtcacctgagaatatatcacagagatcgaatagactgctttgttcgaagcgatctttacgccatttctgtcgtaaatactgcctcttggcgctttaatctcccggtctctttgatgcaggtttctggctaaacttaaatatttatccgcctgagcgatcatcacataagaaagttttatcgtcacaaccaaaaaccctgtgaaaaatgcagccgtgacaagcaacagttttttctttgctttcgtcctcattttatctccatgatccctgtcttaatataaagattatgaaaataaaatgatgatattactttttgctgcttttcgcaacatttaattccttgagtgatccttctaataccttctttgcgatctcaactgcaagtcctgtattcgtctgagaatccctctgaatctcatcgatcacaacataaactagcacctgtggattctccactggagcaaatccacaaaaagatacgatataagttcctgcacttcttggaatcttctgtgcagtaccagtcttaccaccagctgtataatctttcatctttgcctttgttccagttcctgaatcaacagtttctttcatgtattttcttaatttatccgatgtctcttttgagatcgtctgtttcactaacgtcggctctatattgctgacaacttctccattactgcttcgaagttgtttgaccacatgcggtttgtaataatttcctccattgatcagagaacaaaatgcacttcccatctggatcatagagcagttaaatgactgtccaaaagaacttgtggcaagatctgcggctgtcatatcttttgcatcatgaagaagcgatgctgtctgtgcttctccaggaagatcaatccctgtcttattcccaaaattgaaattcttctgatatcttgcgaatacattcttaccttctttggctgcaatctgcatcaatgcatcattgcacgataatgaaatactctgagacaacgtgatcaatccatgtccgcttctatgagaacagtgaatagtatgcggtccaaccttctggtatccatcacaataataagtttcattgccctttaagattccttcttcaagaccagctgctaccgtaaatggcttatatgttgaacctggttcaaaagcatttgatacaattggattcttccagatttcattaaatgcttttgtcttttctttctcactcatcttattaacttgactttgtgagtatttctttaagagattcttatcatctcttgggctttccagattataggaagtagaatttgccattgcatagatctctccattattgggattcatcacaagaatgctgcttcccttacttccatatttcttttcaaacttagaaagctgatcttctgccagtttctgaatattggagtcaatcgttgtgacaactgttttcccattctctggctccacaatggagctatcctgttctaattcttcgtttaaatatttatattttcttccatcgacgcctgataaagtactgttataatactgctcgatccctccagttccgatcataccgtctgatacaaagccaatgacctggcttgccagtgactgattcggataacgacgtttgtatttttcattaaatacgatccctgagacattctctgctttgtctgaagcgataaaatctttcagatctgcgatctgactataagaaagttcttctcgatatacagaatagtaagaatctttatgtctttttataaattttaacagcttatcttcatctaacttcatatatttatgaagtgcatcaatggttgatttctgtacctcttcggatcttaaaatattctttggttctaaaaccaatgtatacatcttctggctggttgctaatgtatttccatcacgatctaagatatctccccttttatacggaagcgtttcactagaataattctgctgtgataatacctgtcttttgtaaattccgttcttaaatatactaaaatagatcaatcttccaatcagtagaacaaaaagaagtgctatgattccgcacgcgatcatcgtacgtcgtttcatagcatcatttaatcgtttgataggttttcttcttttcttcaagtttgccacctcttagtctgcttttggtatcttcccgtactggcgtatgtattctgcatcctggctctcataacgaagagtatgtttggaatctggtttcaccattccatatttctttgccgcagtttctacagtatcaaaacgaatactctgttcaatctcaagattcagatcttcattctctacctgcagcgtgttcaactgtgtctttgcatccgtaagagccgctttttgattcaaaactttcgtacgctctgacagataaaagaaacttgcaactgcgatcacacaaagtcccgcaactaataccttgataaaggccagatcgatcgacatcgctctcttctgattctgtcttgttgactcctttacctgatgttctcttcttggtcttgcctttcttgtcttccttggctgtctgcgcactggctctgcagcaagatcttctatcttccttgctgtgttgccatagatcatgttatatcgttcttgtctcgtcttgtccattgatactctcccttattctgccctttcaaatactcgaagcttggaactttttgctctcttattgtactctagttcttcttcccctggaatgattggttttcttgttaactgttttcctttcgatacgttgccacatacacatactgggaagtttggcgggcatgtacaaggattctcattcttcttaaaagctcgtttgacgatacggtcttctaaagaatggaaggtaatgatacataatcttccacctggatttaaaagatcgatcatcgcatcaatgctgtctttcaatacgtctaattctctgttacattcgatacggatcgcctgaaatgtcttcttcgccggatgtcctccaacggctctgactttcatcggaatcgcacctttgatgacttctattaactgtccggtcgtctcgatcggactttcttttctcttattcacgatatgttttgcaatgttctttgcaaatttctcttcgccgtagtctctgattatatggaatagttccatctcggaatattcattgacgatatctcttgcagtcagtgactgtctctgatccattctcatatcaagcggaacatcttctctgtaagtaaatccacgttccttctcatctaactgaaaggatgataccccaagatctaacaagattccatcgacatgttcgattccaagatcatataacactttcggcatgtttacataattatcacgcacgatcgttactttgtccttaaacggttctaaccgcttcgtgcttgcagcaatcgcatccgcatcctggtcgatcccgatgtatcttcctttctctgatagtttctggcatacatgatatgcatgtccgcctccgcccagagtcccatccacatagattccgtctggtttaatatgtagttcttcgatcgtttcgtctaataaaacggaaatgtgtttaaattccataatccacctaacttatatgcttaatcctaattcctgcatgctggctgcgatatcatccatatcctcataagaattgttctcaatccacttctccttactccagatctcgatgcggtcagccattcctgttaatacaacttctttcttcatctgggcaaattcccgaagtgtcgctgggatcaaggttcttccctgcttgtccatctcacatggagctgcccctgccatgaaaaatctcgaaaactttctggcatctttattaataagtggcaaagtttttagctttccttgaaagctttcccattcgttttgtgggaacacaaacaggcatccatccaatccctttgtcatcacaaattcctgacctaattcttcccggaatcgtgaaggaatgatcagcctgccttttgcatcaatcgtgtgattaaattcccccataaacatggacatcaccactttccaccacttcttaccacttataaatttcattttatacgatagacttataaattgcaaggaataatccacaatcaaatcttagttttttcttagaaatccttgtttttttgcacaaaaaagaagggattccctaaaagtggtttgatttcccttctttttgtgtcttatttcgttattttcttccttttatataagataaatgctgttccaaatactgcaaggatcagtgctaagatctgggataccctgattcctgtagatccgatcatcagggaatcggtccttaatccttcaatcaaaaatcttccgattccataaccaatacaataaatggcgatcaattctccatcaaatttctttctcttcgtaaaaaagaaaatgatcaacagtagtaaaacaagattccacatagattcatataagaatgtcggatgtacctgaataaaggttgctgcttcatttccagatacaacataagttgccttatcatacaatccattggatacgatctcatcaatccttccgtgttcaacaaagaaatttgtcggaatctgcattgcaaataaactgttggtatatgatccaaacgcttctctgttaaagaaattgccccatcgtccaagaatctgaccgacaagcagcccttttaccgccacatctccaaactgaagcatagataaatgtttcttcttgcagaagatatataatgtgattgcacctgcgatcacacctccataaattgcaagtcctccatttctgatctgtatgatctctgacaaatgattcttataataatcccatgaaaagatcacataatagagtcttgctcctacgatcgccggaatgatcatcgtgatcagatagtcaaagactaattccggatcaaatttattttcatgttttgctgcgtaataagaaacgatcaatccaagcaagaatcctgttgcaatgatcattccataatatttgatctcaaaccctccaatattgattccatcaccgacatttttcagtacgatccctaaatgtgggaatctgatttgatgttccatcacttttcttcctttctaaagcctcgttttgtctcttctttgttttgttactcaaatcaaagatatcttatcccatttctcttttcttttcaagtcgcttatggtaaactatctacagtatgaccttggatattttttcaaggtctgttttaagaaatacccatgagaaaggaaattaatagattatgaaattaggaatcgttggattaccaaacgtcggaaagagtacattatttaactctttaacaaaagccggtgctgaatccgctaactatccattctgtacgatcgaccctaatgtgggaatcgtaacagttccagatgctcgtgttgattatctggctgagaaataccattcaaagaaagtgatccctgcagcgatcgaattcgttgatatcgcaggtcttgtaaaaggagcttccaaaggggaaggtctcggaaaccagttccttgcaaatatccgtgaagtcgatgcgatcgttcacgttgttcgttgttttgatgatggaaatatcgttcacgttgatggttctgtaaacccacttcgtgatatcgaaacgatcaacttcgagctgatcttctctgatatcgaagtgttagaccgtcgtatcgcaaaatcaacaaaaggatcaagaaatgataaatctcttgctcacgaagttgaattcttatctaaggtaaaagctcatctggaagatggaaagcttgctaagacattcgaagtcgatgatgaagaagatcaggaaatcttaaattcctgcaacctgttaacgatcaaaccagtcatctttgctgcaaacgttaacgaagatgaacttgctggagaagataatgattatgtaaaagctgtccgtgagtatgctgcagacgttgctgcgaaagtattcgttgtatgtgctcagatcgaacaggaaatctctgaattagatgatgatgagaagaaagaattcttagaggatcttggattagaagaatctggtcttgaaaaactgatctctgccagctactctcttcttggactgatcagtttcttaacttccggagaagacgagacacgtgcttggacgatcaaagaaggtacaaaggctcctcaggctgctggtaagatccatacagactttgagcgtggatttatctgtgctgaagttgtttcttttgaagatttgaaggagtatggtacgatgcaggcttgtaaggagaaagggcttgtacgtcaggaaggaaaagaatatattgtgaaagatggggatattattgtattccgctttaatgtttaattagtttctttgccatagactttgtagtatgtaagaggatatctcgtattcaaataaaaaatagttgctagtgaacaacacgcattttattcatcatttttgaccgatcacttgttcgccgacattccttgtataactcgcttatggaagtccaaaatgacttccatatcgctcagacaatacaccatgtcggctgcaaatcgatcaaaaataatgataaaatgctaatcgttgtttcaccagtaacaaaatgtcaatagttttttaatcacttttttccaaaaaaggcaaaaaaatagaacgtatagattatttccatacgctctatctcacatttcatattaaattttttgaattctacaaactggaagttcgtaactctattcttccaacataatagtctcttcatgtgtctgaacatcctctgtagtcgggtaagcagaaaaaaatgcaatattcataactataagaacaatacatacaacgatgattactgcaaaggctattcctatcgttttccatattcttttacgttgacgatttctgattgccatctgttcagcaatatgtgctagttgctctgcataagcattctgtttttcttctgttgtttgcacatcactatctacctttacttcaagcaactgacttgtttgaacctctaatacatctgctaattttacaaatacttcagcatctggaaccgaatagtttttctcccattttgaaatagtctgtcttgtcacatggagtctgttggcaacctcttcctgtgtatatccttttttctgtcgataagtttttatattttcaccaagcatctctagttactcctttcgtttgataaaactagcataccgattagccatcaatacatcaagcaacgcaaattaacattcatgcaacgcccaatattacaaggattcattaagtcctctataaacttgaattttgtgttttccatttgacttataaatatttgcttgcttctctgatactcaatttatccatcttgtctttatgagtttcaacaaaatttcttacccaatcctgatttgtcttagaataatctctcagactccaaccgatggctttgttgataaagaactctgaactgccaaagttattcactaatattttttcaagcaattccgtatttgttcgctctttcctacaaagctggtggtcaatagcaattcgacgcacccataaatcttcatctgttgaccactccaacattaggtcatttattcgttcatctgtaaaagctatattcccgacaattctatcaagtccgtctattgtgtcccaccattgatttgttttgatatatttttctatatgaggtacatcatcgaattttaaaaacttctgcattgccacaagataatccatcacaaaataatgaaattctctatgttcatctgcataacatctgtcaagcaaatcccagtcaattatttttttgcgtttctcaaatttcagaaaatccttgtaaattgcttttcttttaggtgttggtaaaccataaaatgaaaacaaattcctcatatacgccgccatttttacagcattttcatcatctctatttgcttcaaatttttcttttagttcaaggtatttatccatttccattcctttcacacttccaaatcccgatttccttgattctgcaaattttatcgtcttgttctattcttatcaaaattcttttttaatgctatttctgttgggagaatagacccaattaaagggataagttgaacaccacaaataattcctcccatactcccaacacaatcttcactttttccaattactaaaagcatgaatattactgttattggcaacataaccattccacagacataccagactttaccgcaatatttatgagcaaattcccatgtgtctttattcttcatagacatcgaagtccgatatccaaatactgaatttatttcctttggagcctttttcataaaatatcttccaaaaccaatcatcgtaaatggaagaagcaaatccataatcaacataaaaatccaaaactccattgtaaatctcctttactataacttccgctttgtattttcgtttttattcctttttgtgaaattctttcaaatttaattcacgtttcaattcttcctctgacggcagataggtgaaatatttcgatgcaaatatctggtgattatcttcaggaagcgtatattttacaatagaatctcccttatctgcacaaagtacaatcccaataggctgcgtatctccttcattcatcatttcacgggtatagtaattcacatacatctgcatttgtcctagatcctgatgggtcagtttacccattttcaagtcaatgagaacgaaacattttaaaatatagttgtaaaataccagatcaataaaaaagtcctgtccatccaatgtaaaccttttctggcgtgctacaaatgaaaatcctcttccaagtttcaaaaggaaatgttgaagatgatcaatcaatgcctgttccaaatctccttcatatacatgtgtgtcaggctgaatctgcagaaattccataacataaggatctttcactattttctcatattctggttttggctctgttgtttgaatttcatttgcaaccgctatcttatcccggcttgctaaaatacgctgataatacatcgtattgatctgccgttccagttgacgaacactccatgctgcttttgcacattcttccatataaaatcttcttgcctgttcatcatttatacgcatcaagacacgataatttgaccagctcaattcaggacacagtgtgtctcgaattggaaaagtgcaataaaactgcctcatcttacgaagattcgatttatcaaaaccttttccgaactctgcggtcagctgctcagaaagatattccaataatttctttccgtattctgcgcgatcattttctccacatgctttaaaaatctgttctccaatttcccaataagttgttaccatagcagaatttaccgctgtgcttaaacgatgttatgcagacacaatagaattacgaatagaatgataagtctgttctgcattttgatttttttgtaaattataattcatgctctttactcctctgaatttctaaaatagaacttactgttcttctattgattcaatattttcaattcgcatcagcttaactacctgcttatcttttttctctgtataacaaatttttatccattcatcatctgtgtctattatcttgcaggataattcagtttttcccgcaaaactaaaaatgaactctgatctgataatacattgttttcctacaagatcattaatcagctttgacatatatgccactcctctctgatttttctccaatcgttttactttcgtttctaaacgctttacttttcccggatacgctgaataacaaagtaacagcaacaatgctacaattccaaaccattccatattattctccttagcaaacttaacgctagcatatctgttccttaaaatatcttttgccattcaaatcatatcacactatcagacatatttccatttcaatttactcagtcaagtcacttctctcagctacatttcctgtcggcttgcttctgtaaccagcatccggttaatcttttcctgcatggtttcctttgcctcttcgttgaaatgataacggacaatatatactcataagaattgttgaagaaacattgaaaaataaaggcttatagacagtcacaggcggggcttgtagtaaatggaatatagatttgtagataggcacatctgatattgaaaacgggtgtgcttttctattgctgtaaaacagcatactaactcatttctgcttgattaccatgcacttatcagagcaggatttgtcaagagcctgttgcgaagcaatgctcgcactcttgataatacacgaactgataagtataatatctaaagtagaaatgaattaacttaattcaaagttttcttgtaatggtttcaagaatgaattaattgttaattttaaagtatttatagaaatattgagggttatgtcaaatcattctaaagttaaaattttgttttcttaatatttgttattatcaatgtactatgttaaattttatgaaataatagtgaaagggtgattatatgtttaaaaggttacaaaaaaataacaggatagaaaatgtacgtctcgaagaaaatacaaagcactttattgatggttttaaaaaacttgtagaacaaaataaccaacctacaataaatagattaattaagtttatggcaaattctgtacaaggagaattaatttccaaatgtttatataatgatagaaattatgccgaatacactaggtacattgtttatagtttagtgttgaatttgtcatttgaagaatttcatgaatgcagtatcaaatttaatgtagaagaaacaccaataatatcatgtatttggaattatactagaatgtttgatagtctagaatatattggaaaatgcaataaaaatccatttgatggtgatgcacattctggaaatatcaacgcatgtttaattaatcctttaggacttgtcattgttgataatggtaatcattctgtgaattctgcaatagtgcataatgaaggggaaataattgcaaatgttactgtagatatatctccagtattggaaaaataaataataattttctaaagaataattcggaaccttttatttatactttaggattattttttgaaatggctagagtattaaaagaaaggcaggacaggtgacaccgtgcgaagcgaaaggtgtcgtcctgttccagccttgcaggagtggctttagccacgactgctttgcccccggtatctaacagggggcacaaatacgactagaaactgtaattaaaattcttaaaacactgatttcacaaggctttgagccactttaaagcagatgtgacaattttgcaaaatgtcacatacctgtagttttatttgacacattaaattgattatgataaaatttctttgttttcaagcaaaggagactgattatgaataattactatataacgaatcaacctaaaaagaaacttatctctgtacaattaaatccgatgaaacattgtacagagtatagcatataaagaaatgcgtaagatttcatcggaaatgtggcaatgaagcaatgtacctttgtgggtagatggttttattgtctcttttccgtatgttataaaacgtaagggattaaggctataggcaatgttttgtctatagtcttttgttatatattcataattttagcaggagactattgcactttatgtattttgtctcctgtttttttatgctcaaaaacagagaaaggaacatgaaatatgagtttattagaaattacaaatttatcacattcgtttagtgaaaacgtcttatataaaaatgcagatttttcattaaacaaagaggaacatgttggaatcgttggacagaatggaacaggaaaaagtacgctgattaaactctgtacgggtcagttgcttcccgatgacggacgtgttacatggcaatccaaaacaagtatcggttatttagaccaatacgctgagattaatttgcaacttgatatgaaaagttttttgaaaactgcatttttaaatctttatgacttggaagaaaaaatgaattacttgtatgagaacatgcaggagggtgattttcaaaacttaaataccgctgcgaggtatcaagaagaattagaacggcaggacttttatctgattgacacaaagattgagcaggttgcaacaggtttggggttgttggcaatcggtttagacagacccattgcacaaatgagcggcggtcaaagagcaaaggtaattttggcaaaacttttgcttgaaaaaccggacgtgttgcttcttgatgagccaacgaattttttggataaagaacatgttgattggctgtcagaatatctctgcggtttaaataatgcttttatggttgtttcgcatgattatgcttttttagaaaaaatatcaaatcgaatctgtgatatagacaatcataaaatcacaaaatattatggtacctattcggagtttttaagaaagaaaactgccttacgtgaagattatatacgtcaatattccgcacagcaaaaggaaatcaagaaaacggaggaatttatccgtaaaaatatagcaggaagaaaatcaaaaatggcaaggggcagacaaaagcaactggatagaatggataaaatggaagccattgaccaaaaagaaattataccattttttcattttcgtgaaatgcctttgacaaatacggagcatttaaacgtcaagcacttatcggttggctatcactaccctgttttatctgatattaattttacagtaaatggcggacaaaaagttgtgataacaggttttaatggcattggaaaatcaactttattgaaaacattagtcggacaattaagtgctttaaatggttcgttttctttttcagaacaagtgaaactgcgatattttgaacaggatttacattgggagaatgaggaaaaaacgccaatacagatagtgtctgattgttacccgtcacttacgataaaagaagtgagaaaaaatctagcctgttgtggaattatgggcgaacacgcaatgcaggctattggcacattaagcggtggagaacaggcaaaggtaaagatatgcctgttaattcttactccttgtaattttattatcatggacgagccgacaaatcatttagatattcaagcaaagcaatctttaaaaattgcattaaaagaatttaaaggcacagtgttacttgtttcccatgaacctgatttttataaagaatgggttcagaaagtaattagcattgagaatatcattaagaaaagataacttgttaataattcttctgccagaatattttttcaaaaatgaaattgaaaaatgctgtgtggcggtaataaaaaaaccgccatccacagtttcttatttgtgtgtcataatttatgaaaacgatggttgagagactatcgtttttttaacggtatttcataggagcgttgaggcggttataggagaacacgccttatgacaaacctatgcgagcacattaatttaaaaaatccgttactgttaaaaaaatttattttaatacaataattccctgcgcttgtaaatgtggttttcgcattacacaataggaataatcaaaggagtacaagaaccatataccgttgttcttgtgcttttttgctgtttgaaaatatttttaaatccatttaaagacaggataacaaatctcatctctgtggtgagtgtcagagcggaaagaggtaagaatctctacgcttttacattgcacaggaggtgagattatgaaaccttcttcatttgagagtgccataaggctacagtttgactgccttatccgcaaagtcatagacagaacagtcaagaattattataggaaacttggcagacgggcaaaacatgaaatcccgttctgtgatgtaacagaaatggatctgaaccatgccggtgttccagatgacaagtagaggtattgtttatgattgattgacaatgccttttttgttgcccttttttcttttacacctttggacattgtgtccagaagtgtcctgctattacttttattatctccgtaaatataacgataatcctcacaaaaacaataataccaccaatcagacctccaacgatacaattcagtgccagtattcccatacttcctgcaattccaaaattcttcggcacaagaaacatacacatttttctgataccatagggacatcctaccaaaatccaataaaggaaataatcaaacctctgctttattgcaaacctccttcgtttattaaattcctgttctcatcccatatccgttcctgtaccgggtgctgatgtttccgggacgtattaaccagaaaagacacgctgaatgcctattcagttctggtatcactatgggcaggctgtttcgttttcaaggttcgtgtaagaagtaaaaaaagattcttacactaaacgaaatgctcagagggttttttacagccccccttactgcatcttttttgatttcgtgtcatctttttaaagttccttacacaatctctgtactgacgaaacaaaatacggacatgttttgaaattgttttttacaaaatacaattttggtctttaaggtaaaaaaataagcctcaagagactttttaatcattttggagctccaactctttaaaattgattgattaagaaatctcttcaaacttactacaccagcaactatttttatttgaatacgagatattctcttacatatttgaagtttgttgacaataactattgattaacaaaatatattagctaaattataaccatttttctaaaaataatactgtcatgttttaatgtattattttatatattatgttttttaatattttaaatatagttgcatatagtgctaccccaataactactgcgatcagctgtataattaaatctggtattaacattgcttccacctctatttagcttcttctgcttcccagataatgatgtttccttcatctttaccggagtgttctttttttagttccctgacttgttgctttgttacttttcctttggctttgtctttaatcgttacaccttggtatttatttgttgtaactgtgtcttctttctgcttggccgaattggttttgttttgtccataagttgtgcctgcgctgtatagtgcagctgttaggcatacccctgcaagtagtattgataattttttcatatcttattttccttaatgtttcatgctatagcatatcatatttttcatggaatatcaaatccctaatatctaatagtttttcgacttattaccgcacacacaatggatgcagcaagcattggtataatactatcttggcttaaaatttgaataaaatttccaatgaagcaaacaatcataaatatactgattattttcgctgttttagcaccatagtcttttggatatctatgtgctatagcccagctgatgactgctagtattatacatgggatcattgtgtaatggatgccgttatatgacaatatatatccactatttcctgaccaactgttgagattcaaactatccaaaatcatatctccaattgacaccgtcttctcataaaatgggatacttagaaatccattgatcataaccagtaccaatgcctctgttccaaatcctaattgcttttttaaaagaattttttgcaacaggttctctaggatatacccgatcagaaatcctaatgtattaaaaatgatatcatcaatatcaccaattcttcctgcaaatacaacttgtacaaactcgatcatcaaagatatcaatgtccctacaattattgcttttccatagttccattttattttctttataaatataggaacaaaaagtcccattggcagaaacattaatgtatttaacagcatcaatttccagctttcattcacaaatggtacaatattccaggctgtaaatcctccatatgaccatgatgtgatgtctaatactctcgtgaccatgccaacggttgctatgtaaaccaaaaatatgtattttatgatccatcctggctgacatataatctttttattatatcgtaaatagtaaattgtgcttatgactgcaaatgcaatcgttgccataacaatagcttgagctagataactactcccaagcagaatcttctccatcatgttcttttctcctttaatccaatcattcctgcacataacaaaaatactattatcatataagccacaaaatcagaagaatatatttgaattatttttatgtgtttaggaaacaagaaccgcaaaaatacatttgcaaatatactcccacttgtacatagagctactgttttatataccaatgttttcacttttcttgtattcacagccagtactttatatacaacgatgaattctagtagcaaatttaaactcatgaatatcaatgctttttcagttgtcattggtaataaattatttgatttccatttcatctgcggtatcacataacgataacctgtctccctacgtattctttttagcaaattacttatttgacgatactctttctcattcttataacaaaaataacctgaacattttactgacattaatattttttcattctcttgtttcattgttttcattttacttactgttggcataatcaatgtttcatcaagatttaattccgatgacaacctagtattcttatgtaaaaacccaacaattttaaacgtacaattttcagttcccaaatatcctgccttaattttctgattcaaatgaaaaactttttgataatcatatcctgcaattaatggaatctcttgattcaaaggtctttgatactcttttaaagtaaagcaacgacctttttcaatatgttgttctatcttcttttcacttatcattttctctggcatctgaagtacagttaaatttgtaagatatccatcttccgttttgtcattatatgatccagatgcaagtttttcattcccacgaaaatattcatgataagatagaatctgtctggaatattctctgtataactctgctttttttaattctttatatactttttttaaaatactgagagagtttttctgatgaaggaattccatatagccagaatttctattatcatattcatccgataacttccatactccagggtattctctctccacttgttcattatgacgatcaatcttattttgatacgaatatataataattcccagtaaacacccaatgcttaatatataaaataccataaaacgaactacatatttcctcatttatcatttctccacacaaatcgctattcctatttttattttctttttataacgattttcaacgaatactttatattttccatcttttttcacataaaagtcatgtataatatcgaccgcatgcatcacatatcgttcttttcctgtcccatctataattcctgctacaaaatccttatcctctctttgtatttcttgagatgaaaaaacggtcaaatcaattttctcgcctttttttaattccagctcttttgtttctagccttgtttttgcgtttaatggctgaactacatctatttcttctccttttttgatattttgttttagctttgtaactgctaagtttgtcccgatcctttttgcagtatattctttcaaatccattgtatattctgtctcttcttcaggaagatcctcttctatttccgttgcccagactgtctctacataaattttatgatagccgatcgtgcttagaataattaccgcaacgaccacaaaggataatcctatacaaaggaatgttcctgccattacattccttgtgtttttgttttcaattgatttaattctcaaaattcgtgtctttaattggcttttgtcttctcctaatgctgcgcacagatatgcaccttttgcaaatggtgatatcccgatttcacagatcgtcgtaaaatatctttttttgcttttcataattgtggttgattctaaatcgcagtatgtttcattccagctgtctacatccatatctaattgctttaccaatggattccaccaatgaatgacccttacaagtccgcataactgtttccacaaaatatctttgtgcttacagtgaatcaactcatggatgcatataatctttaattcttctttgttatattctctttctggaagtaaaatcatcggttttagaaatccgcaaataattggtactgccaacccatatacggttttgatttcgacatttctacgaacacctacttcttctttccattgattcttgcaatctaaaatagatctgctgcatacacatgccctctttcgtaattgattcatttgtgcctgaatacgtattgttttcagtatagcttttaaaaatccaatcgtccaaatgattcctacaacaaaaaatacccatcctaccaatggagacagtgcaaacattgtataatcttcttcatatacataataaatgaaatagatcaatacaattacgattggcatcagaaatgataaaactgctcctcttaaaacagtaatgcacatactgatcagtccttttcgctctagttgttgccttatcttgtgaaagcaaagatacgaaatacttcctaccaaaccattcagcagtatcatactgatgacataaatatatatttttttaatcatccaaatcattgatcaaatcctttaattcttctttctcttcttttgatattgtgtgtgttaacgtctgaaccaattccttcaccgacccatcatgccaaaaatccttcatcaattccatctgttcttcacgatacatttcttctgtgatctttgctgtgacatagctgtaattgcctttcacttgtgtatctacaaatccttttttctttaattttgtgatatatgtctttactgtgcttcttgtatatttcctgtcatatacttgatctagataatcaataatttcatataccgtaatcccatccccaagtttccaaatacttttcatgataagtatttctacttctgataattctattaatttcattgttcttccttctatctgaactggttattattataaccattatataaatcaagcttgtctttgtcaagattagtgataattataacgaatttgtatacaaaaactatctttgatttttcacttttgtctttttctcagccttcgcatatccatttttattgactcatacatattcaacacgcttaaaaaagccaaataaaaaatccgacccaaggaagtctggtcagattttctagctttgttatgttttgtttttgttttatgttagttagtcttaactaactgttattataatatcctatcttggatgttttgtctacctttatttttgagaaactttctcaataccaaggatcttttctgcctttgctacagcttcttcgcttggcggatttacgccttctaatgggtattttattcctaatttttcccatttaaagagtccaagtgtatggtatggcaagatttccactctcttaactgtctttagtccatcgatgaaatgttttaagtctgctagtcctttttcatcgtctgttaaatctggcactagcacgtgacggatccacagatctactccgaggtctgagatttcctgtgccattgctaaaatattactatttggacagcctgtcaatttcttatgtttttcctcgtccatttcttttaagtctagaatgacaaggtcagtgtatttcattaattctaaccatttgctgtgaaatggttcttcttttgtatatggattagcagaggtatcaagtgcagtatggattccttctcgttttgccaatttaaaaaattcgatcaagaactcgatctgtagaaggggttctccaccgctgactgtaattcctccatcacttccccagtacatgcggtaacgcaaagccctctttaagagggcttctgcctgccagtcttcaccgcagttttcctgccaagtctccggattgtgacaatatttgcatctcatccggcagccttgcatgaaagcgataaaccgcacaccgggaccatccacgagaccaaaagtctcgatggaatggatttttccggttattttttcattcatagttctattccactaatttaaattacattgttgcatggcatgttctggaaataacgtccatctgctgttctcttgttaagtcgatgaacttaactgcatatccagatacacggatcgtaaagtttgcatattcttctttttcaggatgttccatcgcatcgatcagtttttctttaccaaatacgtttacatttaagtggtgagctccctgatcaaagtatccatccataacatttacaaggttattgattctttcaccctcttcatgtcctaatgcatctgggttgatcgtctgtgtattagaaataccatctaatgcccattcatatggaagtttagctacagagtttaaggatgctaataatccattctgttctgctccataacttgggtttgctcctggtgctaaaggttctcctgcttttctaccatctggcattgttcctgttgcttttccgtatacaacgttagatgtgatcgtaaggatagatgttgtaggctcagagtttcgatatgtgtgatgttttttgatcttagctaagaatgttcttaacagccatactgcgatatcatcagctctgtcatcatcgtttccgtatttagggaagtctccttcgatttcatagtctacaactaatccatcttcatcacggattgcttttacttttgcatatttgatcgcacttaaagagtcaactgcatgagagaatcctgcgattcctgttgcaaatgttctttcaagttctgtatccattaatgctaattccgctgcttcatagtaatatttgtcatgcatatactggatcaagtttaatgtgttcacataaagatctactaaccagtccatcataacatcatatttctccataacttcgtcatagtctaaatattcagacatgattggtttgtaagaaggtcctacctgctgttttgatttgcagtccacaccaccgttgatcgcatataataagcattttgcaaggtttgctcttgctccgaagaactgcatttcttttccagtcttagttgcagatacacagcagcagatcgcataatcatctccccatactggtttcataacatcatcattttcgtactggatagaacttgtacggatagagatatcagctgcatatttcttgaagttttctggaagatcagaagaatataataccgtgatgtttggttctggagatggtcccatgttctctaatgtatgtaagaaacggaagtcagtctttgtaaccatggaacggccatcaactccgataccagcaaggtcaagtgttgcccatactggatctcctgagaataactggttgtaagaaggaattcttgcgaattttaccattctgaacttcattgttaaatgatcgatcatttcctgagcttcttcttctgtgatgattcctttgtcgaggtcacgctggatatagatatcaaggaatgtagcaacacgtccgatactcatggcagctccattctgagttttgatcgctgctaagtatccaaagtacatccactggattgcttcttttgcagttttcgctggtcttgaaatgtcaaatccatagatctgagccatttctttcataccttttaatgcttttttctgttctgcaatctcttcacgaagacggatcacatcatctgtcatcacaccgcatccacagtttgcaaaatcattttctttttcttctaataagtagtcaattccgtataaagcaacacgacgataatcacctacaatacgaccacgtccataagtatctggaagacctgtgatgatcttgttatgtcttgcttttttcatttctggtgtgtaagcatcgaaaacagctgtgttatgagtctttgaatattttgtaaagatttcatgtaatctttcacttggttcataaccatagttacgacaagattcttctgccatcttgataccaccatatggcataaatgcacgttttaatggtttgtctgtctgaagacccacgatctgttctaaatcttttgtttcttcactgatataaccaggtccatgagaagttaaagaagatacgatatctgtatccatgtcaagaactccacctttttttcgttcttctttctgaagtccctgtaagataccccatagcttatctgttgcttctgtagatcctgcaaggaagctttcgtctccatcataaggtgtgtagttttcctggatgaaatctcttgtattgatttcttccttccagattctacctttaaatccttcccattcttcaaactgtttcattttgaaaactcctccatttcttttggattaaaattattataaaaactcctttggttagctctatctaactcaattacattataacaaaaataaaattgaatacaatatacttaaccgataaactttctcgttaaataaataacaactcctgtttttcatatttttttgcatacaaaaacagtatatggtccaaaaaattatacttcagaccatatactgttttttcatgttcaatgactatataaagaaactttttagtgatggaataatctgattcctgtaaatgccattgccatgttgtacttattacaacagtcaatgacagcgtcatctcttacagatccacctggctgtgcgatgtattttacaccactcttatgtgctctctcaatgttatcaaagaatgggaagaatgcatcagatcccaatgtaacatctgttaacttatctaaccattctctcttttcttcttttgtaaagacttctggcttctcagtgaagatgttttcccatgctccgtctgctaaaacatccatgtattcatctccaatgtaaagatcgatcgcattatctctgtctgcacgacggattttttctttaaatggcaggttcataacttttggacactgtcttaaccaccagttgtctgctttctgtcctgcaagtcttgtacaatgcacacgtgactgctgccctgctccgattccgatcgcctgtccatcttttacaaaacatacagagttagactgtgtgtattttaatacgatcagagaaatcttcatatcgatcaatgcttcttctggaatctctttgttctcagtcacgatatttgataataattcatcatcgatcggaagttcctgtcttccctgttcaaatgtaacaccaaatacctgtttatgctctaatggtgctggtgtatagttctcatcgatcttaatgatgttataatttccgtttttctttgcttttaagatttccagtgcttcatctgtgtatcctggtgcgatcactccgtcagatacttctctcttgatcagacgtgctgtatctgcatcacatacatcagataaagaaataaagtcaccgaatgaagacatacggtctgcacctcttgctctggcatatgcacatgctaatggagataaatctcccatatcatctacccagtagatcttctttaaggtatcagacattggacgtcctacagatgctcccgcaggtgatacgtgtttgaaagaagttgcagcaggaagtcctgttgctttctttaattctcttaccagctgccatccattaaatgcatccaaaaagttgatgtaccctggtcttccgtttaatacttcaattggaagttcacttccgtctgccatgtagattcttgatggtttctggtttggattacatccgtactttaattctaattccttcatttttcttctcctttgatctgctgatcgactgattatttgttcttatttacgattcttgtctcatattctcctgttgcaatatcaatataacgtacaaacagagatactttgttgtcatcgtttaagctgttccaaagtatatttgtgaagtcatcgatatcttcttcgatcgctactaatttaggttctccttcaaaacttggaagtggattcccatcatgcatatatgtgtggataaaacgtccttctcctgcgattggattttcatatgtatatgtaaatcgattgcaactttctggatttccattgttgctctttaaaatagacattgcatagtgaaatgtcccatctttaatcttcatcagaccagaaattcttggtgtatagtttggtccgtctggttcaaactcacgacttcttaaagattcttcaaaggtaagtcccttttctcttccttcatatactgtgtctgtctgatccccgttcgtaacgatcgtctcgtctccaagaacacgaactggtgcataaatgatcaggcttggatcttctagtttagcaggatcaaatgcctgtgtgcggattccttccccttcttctacaaagacacgattacggctattctcactgcgtcccatgataaagtatgcagtgaccgctttcttcccatctttggatcttccgatgacgattcctcgtcctgggtaagcattttcctttaattcctgagcaagagctaacttcttcattggtcttaaatctccttcttttgaaaatcttgtttttttatttcttctattgtatataaaaaatggattgaatacaagaaaaaactaacaattataaaataaagggcaggtttcctatatatttttgtaacactgtcctttatttctatcattttttacatagttatgcttttttattttacaatccttcttatagcaagcaactccataaggtagaaattccgcataatttattattttaacatacaaaaaagaatggaacatcaatccctgacattccatcctttttcttattttatattcaaatattacattctcttgattcgttcaatagcttcgactgtattctcatagttaccgaacgctgtaagtcggaagtatccttctccgcttggtccgaatcctgatcctggtgttccaacgacgttggcatcttctaacagatgatcgaagaattcccaagatgtcatgttgtctggtgtctttaaccagatgtatggtgcattgacaccaccagatactgtgtatcctgcatcctgtaatccgttaaagattacttttgcattgttcatgtagtatccaacctgttcttttaactgagcttttccggcttcagagtaaactgcttctccagctctctgtacgatgtatggagctccgttatattttgttccgtgacgtcttgcccataacgcatgtaactgtgtatctccacattttaaatctttagggataacagtatatcctaaacgaactcctgtaaatcctgcgttcttagagaaactctttaattcgatcgcacatgttcttgcaccttcacattcataaattgtatgtgcaacgttatcttctgagatatatgcttcgtatgctgcatcataaatgatcacgcatccgtttttgtttgcatagtctacccatccctgtaactggtcttttgtgattgttgatccagttggattgttagggaagcaaaggtaaatgatatctggcacttcgcttgggaaatctggtgcgaagttattctctgctgtacatggcatgtagataacatcgctccatgtttctgttgctttatcatatgttccggctcttcctgccataacgtttgtatctacatatactgggtatacagggtcacatacggcaatcttgttatcctgtgcaaagatttcctgaatatttccagaatcacattttgctccatcacttacaaagatttcatctgctttgatatctgctccacgatcctgataatcattctttgcgattgcatttcttaaaaattcatatccaaggtctggtgcgtatccgtgaaatgtttctgcatgtcccatttcatctactgctttgtgtaaagagtcaatgatcgctggtgccagaggctgtgttacgtctccaattcctaaacgaataatatttttgtcagggtttgcctcggagtatgcatttacttttttcgcaattgtagaaaataaataacttccaggcagtttcaagtagttgtcgttaattttaaacataaattcctcctagttttgatatgttaatgattctttaatcatctttgccatttcgataagacccactccactgttcatgcttctttgttgtatatatgcgtgggcttcactctctgtaatctgattattctgcatcagtaattctttgacttcttccagaagacggacttcttctctcgtacgttgttttggacgttgttttcttcgtctttgcttctcagaaatttcggtaacgatctctctcgttttctcgactaattcatacccttttaacggcatcgaaagtcctatgacattcggatacacgcagtcatctaaatattggcgagaagcgatcagcaacatcttgacctcttcagaaagatattctcttaattcactgtagatcatatcggaacatttgtatccgcagacgactagtccttcttcaacaccttccatacgctggactacctgtgcacccgttgcacatacagcggtcacttcaaaaccacttcttaccagaagattcctaatgcttctggcgacttcttgtttcgggaataaaacgatgacgtttaccaagcttctcacctcccgtatcatgtatatatcaatcattagatcttgtataaataacgatcgacttcccattgtgatacgaacttctgataagactcccattcagcactcttagcttcaacatacttgttaaaaatatgatctcctaaaagttctttcatataagtgctttgtttgaaaatctcaagagcttctttcatgtctcttggcagtgtattaatccctgcttcttgtttttctccctcagccatctcatactgattcttcatggaaccttttccaggtgttaatttgcgcttgatcccatctaatcctgctgcaaggctgactgccagtgcaaggtaaggattcgcagcagaatcagggcttctaaattcaagccttgttccgcttccacgggctgctggtactctgataagtggacttctattcgatggtgaccatgaaacatccacaggtgcctcatatcctggcacgattctcttataagagtttaccagtggatttgtgatcaggcacatctcatttgcatgttccataactccagccatgaagtgaaaagcctcctcactgattccaagatcattcttagaatcagcgaaaatattcttcccattcttccataaagacatgttaagatgcattcctgaaccgtccactccagtgatcggttttggcataaaacttgcataaagtccatgtcttttagcaatatattttacgatgaatttaaatgtgaggatgttatcggccgttcttaaggcattgtcatacttaaagtcgatctcatgctgtgctggtgcaacttcatgatgagatgcctcgatctcaaatcccatatcttcaagattcaagatcatatctcttctggcactttctcctaaatctaacggagctacatcaaaatatccggctttctcatgagaaaccgtcgttgggcggccttcttcatctgtgtggaataagaaaaattcacattccggaccgacgttaaatttataacccattttctggcactcaaccatcactcgttttaatacatttcttggatctccagcaaatggaagtccatcttgtccgtatacatcacagatcaatcttgccacgcggtttcctcccgcattccacgggaagattgcaaagctgtcaagatctggatataaatacatatctgattcttcaatacggacaaatccatctacactagatccatcaaatgtacacttattatccaacgctttctcaagctgtcttgcggtgatcgcgacgttcttcattgttccgaacaagtcagaaaattgtagtctgataaattcgacatcattttctctgacgaggtctatcacatcctgttttgtgtatcgacccataacatcactccttcttaattaaatctgtgcgatatcaactacgctgagctgatctctgtttcctgtttccaaactagtcagtagagcatctgccgtatcaagacttgtaaggcatgttactcctgtttcgattgcgtaacggcggatcaggaatccatctctgcttcgacctacaccctgagatggtgtatcaatgactaaatcaattttatcatctaaaatgagatctagcaagtttggagattcttcttctaatttattaatctgttttgcatgaactccagcttcatttaagactctgcaagtgctctttgttgagaaaatctcatatcctaatgcttcaaatctgcgtccaatatcaatcgcatcgatcttatcggagtctttcactgttaagatcatcttcttgtattttggaagatttactccagctcctaagaatgctttatataacgcttcatggaagttcttagaaattccaagacattcacctgtagatttcatttcaggcccaaggctgatctctgctcctcttaatttttcaaaagagaatactggtttcttcactgcatagtattcagattctttctgaagtcctggttcatatccaagatctctgatcttagctccagtgatcactttcgctgctaacgctacgatcggaatacctgtaactttactgatgtaaggcactgtacggctggatcttgggtttacttcgataacatatacttcatcatctgctacgataaactgaatgttgatcagtccgataacatgtaatgattttgcaagttttcttgtatattctgcaatgattctcttaattctatctgttaaattgatagatggatatacggaaatactgtctcctgaatggattccagcacgttccacatgttccatgattcctgggatcaggatatctgttccatcacaaacagcatcgacttcgacttctttaccaaccagatatttatcgatcagaattggatgttcctgttcgtaacggttgataacttccatgaatgccgtaatatcttcatcagatacagcaatctgcattccctgtccaccaagtacataagaaggtcttacaagaactggatatccaagtttatgagcaacttctaatgcttcttcacatgtaaatactgttgttccttttggtcttggaatacagcattcttccaagatctcatcgaataattctctgtcttcggctgcatcgacattttcagcacttgttccaaggattggtactcccatcttcatcagtgcttctgttaatttgatcgctgtctgtccaccaaactgtacaaccgcaccatctggtttttcaagatctacgatactttctacatcttctgctgttaatggctcgaagtaaagtttatcagcaacatcaaagtctgtagaaactgtttcagggttgttgtttacgatgatcgtctcgtatccttctttacttaatgcccatacgctgtgtacagaacagaaatcaaattcgataccctgaccgatacggatcggtccagaaccaagtaccatgacttttttcttttcggatgtttctttcacttcgttctcaccatcatagcaagaatagtagtaaggtgttgctgcatcaaactcagctgcacatgtatctaccatcttatatgctgcatggatattatattcatttcttaattctttgatctcacgctctgtcttacctgttaagcttccgatcaccttgtctggaaattctaagcgttttgcttcctgtaataattctttgtctaatgtatcagctttagctaatttcttttccatctcaactaaaactgcaatcttatctaagaaccaacgatcgatttttgtaatattaaagatcgtatcgtaatcaaatccacgacggatcgcttctgcgatcacatagatacgaagatcatcgatcttttcaagttcttttaataactcgtcgtctgttaatttatcataatcaccgaagagcaagctgtccacatgctgctctaaagaacggatcgctttcattaacgccccttcgaagtttgttccgatactcataacttctccagttgctttcatctgagttgtcagagtacgttttgcatgaataaacttatcgaatggaagtctaggcattttaacaacacagtagtcaagcattggctcaaaacttgcatatgttttcttcgttactgcattttcaatctcatctaatgtatatccgattgcgatctttgctgttactttcgcaattgggtatcctgttgctttggaagctaaggctgaagaacggctgacacgagggtttacctcaataacgcagtattcaaagctgtctggattcaatgcgtactgtacgttacatccaccatgaacatctaattctgtgatgatgtttaatgcagatgtacgaagcatctggtattctttatctcctaaagtctgagatggagctactacgatactgtctcctgtatgaacaccaactgggtcgatgttttccatgttacagattgtaatacatgttccattttcatcacgcattacttcgtattcgacttccttccatccaccaatgtaacgttctactaatacttcacctacacggcttagacgaagaccattctcaaggatcgtctctaattcttcctggttatgggcgattcctccaccacttcctccaagtgtatatgctggacgaagtactgctggatatccgatcactttagcgaattccacaccatcttctactgttttaacaacctgtcctgcggcgatcggttccccgatcttttccattgtctgctggaattctaaacggtcttctgcttttttgatcgtagatggagatgtaccgatcaatttcactccggatttttcaaggtatccgctctctactaattccatggccagatttaaggctgcctgtccaccaagtgttggaaggatgctgtctggtttttctttttcaatgatcttttcgatgacagaagctgttaatggctcgatatatactttatctgcaatgtctttatctgtcatgatcgttgcagggtttgagtttactaagactacttccactccctcttcctgaagtgctctacaagcctgtgttcctgcatagtcaaattctgctgcctgtccaataacgatcggtcctgatccgattacaagtactttctttatatcttctctcttaggcattttttgctcctttcattctatccataaattcatcaaataagtaagctgtatcctgtggtccagggcatgcttctggatggaactgaactgttcgaatgtttttatttttatagtctaatccttcaattgttttatcatttacattaataaaggaaacttctgcaacatctggatcaattgtttcttccttgatcacatatccgtggttctgagaagaaatataaactcttccgctctttaagtctttcaccggatgatttcctccacgatgtccccaacgcattttttctgtgtctgcacctgttgcaagtgccatcaactgatgtcctaaacagattgcaaagataggtacctcgctgtcatataatttcttgatctctttgatgatctgtacacattcttttggatctccaggtccgtttgataacatgataccgtctggctgatctcctaagatttcttctgctgttgtatctgctggataaactgttacatcacatccacgtttttctaaagaacgaataatgttattctttgttccaaggtctaataatgcaactttaaatccatctccattgaaatgttctttttctgttctggaaacagtttttactgcatctgttactgtatattcttttaattttggaaggatttcatctaaattgaaatcaggatttgtggtgatcattccacccatgcatccatgttctcttaagatctttgtgatagctcttgtgtcaacaccacaaatacctggaatgtcatgttctttcagataatcttctaagtcttcttctcttctgaagttgcttgaagttcttgagatttctcttacgataaaggctgagtgccaaggtttttcagattcgatgtcctctagacatactccataatttcctatcagtgggtaagtcattacgactccctgtccctgataggaaggatctgttaatacttctaaatagcctgtcatggaagtattaaatacgacttcacagatcacttctttttgggctccaaaactttttccctcaaatacgtgtccgtcttccaatatcaaaaatgcgttcatgtaatttttcctcctaaaaagtctctttcatagggttgtattttgtcaggaagaactaacttcctatttataaaataagagttttgccaaaacccttgattttatataaaaaaaaagaaataccctaaaataaaaattacaaagctaagtattggaaattcagcgatcttgtccttccaatacccaagttattttttatttcagaaatatttctctacaaattgtaaaaattttatcatatattttttgtcgttgcaagtacttttttgtatttttatatgtttttttctttattcatccgctcttcactctctcttttagaaaaaacacatccgcagaaattctgacgatacaaattatattctttcgataattgaatagatctctgataaccacctttctttttaaaatcagatggaagaaatctgactcctgctaattctcctgctttctgtccaagttcattcagccatgcagcattctttaatggactaatcgtaagggttgttgtgaaataatcatatccaccttcttgggcaagttttgccgcctgatccaatcttaatttgtaacaacgataacatctcttaccaccttctggttcctgttcatacccctttgccatatcaaaaaaagtctgcggggcatatccagcatcgatcactttaataggaagattcatttcactgaccagacgctgttgttcgtggactcttttttcatactcttctttggagtcgatatttggattgtagtagtcaatggtgatatcaaaatattgggagagatattccatgacatagctgctacatggcgcacagcaactgtggagtaatagggttggtttggtttctcctaagttttcgattactttatctaattgtttttggtagtttattttgttcattggttgtctctttctgattttgttttttactgttttctttctattatactagtatttatataaaaagaaaacaccggcagttaattgttagcactcttttttcatgagtgctaatttttacttgacttttatcaactttggttctacaatactctttgtaaaagttctatttggcatagaacacttgattaagatcataatatttttagataaaggagtgtacaaattatggcagaaacaaagggaactctttccattaacagcgataatattttcccaatcattaagaaatggctttattccgatcacgatattttcttccgtgaattaatctctaacggatgtgatgccatcacaaaattaaagaaattagatatgatgggagaatacaatttcccagaaggacataaaaacaaagttgaagttatccttgatcctgagaagaaaactttaaaattcatcgatactggtcttggtatgactgctgatgaaattgaaaaatacatcactcagattgcattttctggtgcaactcagttcttagaacagtacaaagacaaaacagaaggtgaccagatcatcggacattttggtcttggtttctattctgcatttatggtagcggacgaagttacgattgacactctttcttataaagaaggagcaaaacctgttcactggacttgtgatggtggtacagaatacacaatggcaacaggtacaaaagaaacggttggtacagagattactttattcttaaatgaagaaagcacagaattcgcaaatgaataccgtgcaagagagatcatcgaaaaatactgctctttcatgccaacagagattttcttatctgtagaaggtgccgaacaggaatttgagacaatcccagaagatcaggtaaaagacgatgatgtcgttgtagaacacatccatgaagatgcaaaaactgaagaaaaagaaaacgaagacggtacaaaagaaactatagaagtttcccctgcaaaagatcttgttaagatcaataaacgacctgtttctttaagtgatacacatcctctttggaataaacgtccaaatgaatgtactgatgaagaatacaaaaacttctatcacaaagtcttccatgactttaaagaaccattattctggatccacctaaacatggattacccatttaacttaaaaggtatcctttacttccctcagatcaatacagaatatgattctatcgaaggaacaattaaattatataacaatcaggtatttatcgccgataacatcaaagaagtcattcctgaattcttaatgttattaaaaggtgtgatcgattgtcctgaccttccactgaacgtatcaagaagtgctcttcagaacgatggattcgtgaagaaaatttctgattacatcacaaagaaagttgctgataagttaactggtatgtgcaagacagaccgtgaatcttatgaaaaatactgggatgatatcagtccatttatcaaatttggattcatccgtgaccagaaattcgcagataagatcaaagattacatcttatttaagaatatggaacataaatatgtaacattaagcgaccttgttccagctcctgcaaacgatgatgatgtgacaactttatactatatcacagatgaagttcagcaaagccagtatatcaatatgttcaaagaacaggatatggatgctgtcattttaaatcataacattgattctgcatttatcacacagattgaacagcagaatcagcatatcaaatttaaacgtatcgatgcggatgtcgaagatgcccttaaagaagatgtagatgaaaaagaattagatgaaatcaagacttctttaactgacctgtttagaaagactttaaacaaagaaaatcttgaagttcacgttgaaaaattaaaagatgcaaagatttcttctatcatcactttatctgaagaaagcagacgtatgcaggatatgatgaagatgtatgcaatgcctggtatggaccctaatatgtttggtgctcctgcacaggttctgactctaaatgcaaataatacacttgtgaaatatctgtttgagcatggagatgccgacaatgcgaagatcatttgcgaacagttatatgatcttgcgatgttaagccatacgactttagctcctgacgaaatgacgaagtttgtccagagaagtaatgagatcatggaaatgatcgcgaaattttaatttgtagttggccaactgtagattttgagtatatgataaaaaataaataaacgatcggaagagcagctagagaatttttctcacgttttttacagatcgctgatccgccggctttccttgcgtaactcgccttcaatgatattcaaaccagaactctttgaagctcaaacaacgcaccaagccggctgcgaatccgtaaaaaacgtggcaaaattctaatgctgctcttccgatcgtttatttattttttatcatataccagaagtctaaagtgtggacaattacaagattgaaaaacttaagtgggtatgtatgttaaacggtattgatttctaatctataaatggttccttcttcactcagaagaacataaattctatgtggctggaatttttttgctggtggtgctgggtaataagcatttatagcatacaaacaggacctgtcatcaaacaacaggtcttttatatagatgattcacttatgaaaagaccaagggactttaatgtcccttatgcttttctcttttcttttgctgtttcagctcaaacgttcgttgttttttggtctcttttttcttgcgacttttctctttacgcttctgtttgttctgttcctgctgtaatttcaacacctgctgcgattttgtcccaatgcctgtttccagcatctgcttttttgcttctcgatgcatccgtttcggatttcttcttaaatcctttacaacagtttcaacagctggactgaatttcaaacgaaaatagtgtttttgaatatattcctgcacttcataatcttttggttctacaccaaacgttatcttcgccacagatagtttgccgtcttccgtacgctcaaatatgcctacccaaaatggcttttcaaaatataccgtcagttttccatttgttttgtccataagaatccctcctaaaattaattaggcaaagaatggacaacccggaggggcaggttacttaccctatttacataggacggccgggctacctaccggctctggtacataaatgattgtacgttgcgtttttatctttgcatttataagctactctatcagtaataataccataaaattttcattgttgtatgaaaattttgcttcttttttatctcttcctcatctttacaattcttctggatggatatataatattttggaaatattttaaagaaagctggttttttcatgtgtagtagggatatggatcgttggattcattttaatatggcaatcgttgggggatttcttggtggttttgcaattcttaatcatcatgaactcttcggttctgcacagacttcgaatctgatctctgtgtttgcagactttgcaggacatccggatgcaaattttattgtgcgtctgattggtgtctttatttatatgtttgcattgtcactgactgtgatcttaccaaaatttacaagactacatcttccttatgtcagtctttttatagatgcaatggcagccttgatcgttgcttttcttccatcggatctgaatgatttcattgccctctatccgttgtattttgcaatggcaattcagtggtgttcctttaagggtggggatggatttacctgctctacaattttttctacgaataacctacgtcagtttacgacatctatgacagaatatctttgcagtaaagatcccgatgccttaagaaaatggaaatttttcgcttctgttttgctttgtttccattttggtgttatcatttcttatctatcttgcaaaaactttggacatactggttctcttgtatgttttctgcctgttttcagtggtttttgtcttgtgtggacgagaaaacattttgttgcagtgaaacattttgtctacaactatctgatcacaccaaagaaaagttcagcttatactacagaaagtgagtaattatggaaaatttaatctttagcttaaacgctacagttcctgtctttttgatgatgatcttaggacttgtctttaaaaagattggatggattgatgatatttttgcttcgaaaatgaataagtttgtttttatggttcctttgcctgtcttggtatttgaggatcttgcaacggttgatttttcaaaagtctgggatgttaagtttgtcctgttttgttttatcgttaccataatcagtattacgatttcttttctgatttcttgtctgctaggtgataaaacggtccgtggagaatttattcaggcggcttaccgaagcagtgctgctctccttggaatcgcatttatccaaaacatttatggaaatgccggaatggctcctttgatgatcattggaagtgtaccattatataatatgatggctgttgttatcttatctgtatttaaacctggacagagtgggcttgaccgtactgttgtgaaaaaaacgctcaaaggaatcgtgacaaaccccatccttatcggaattgttgctggacttgtctggtctgcattaaaaattccaatgcctgcaatccctaaaaaggttatttcaagcattggaaatgtcgccactccaatgggactcatggcgatgggcgctaccttcgatatcaaaaaagcttttggaaagattaaaccatctgccattgctgcttttatgaaacttattggtctttgtgccattttcctgccaattgcagtgaaacttggattccgtaccgataagttggttgccatccttatcatgcttggttccgcaacaacagtaagtagttttgttatggcgaagaatatgggacatgagggaactctttcttccagtgttgtcatgttaacaacgatgtttagtgcatttacagttacgggatggctatatattttaagacattttatgttaatctagctaacttagatccaatgtgatctggtatttttccagccagtaattgacttgcagaaggtaagcgatcatctgaggacctgccatcagctgtccataccatggtttaccatagtctttcggactgtctaagaatctgcttagtttatatgcatcgatcagttctttgatcggtgctcctttttttgccataactttcagaagttctttggataagattttttcatagtttggatcataagtctttggatatggactttttcttcgatacaatacctcatctggcaggattccttcccctgctgctcttagcaatccttttaccacaccatttaaacattttaactcccacggaacattataaagatattccacaatcctatgatcagcaaacggcactcgtgcttctaacccacaatgcatgctcgtgcgatccatgcgatccattaaggttaccataaaccatcttagattcagataagaaatctgccttcttctagcttcgatctgatcttctccataaagttttggcgtctcattgatcgtcttttgataagctgttcttgcataagattctaaatccactttctgtatgatatcatcatttaacagcatttttcttggctgcatatccatagaccatgggaaaatctctgccttgaagcattcctctttatgaaaccatggataaccgccaaaaatttcatctgcacactcccctgttaatgttactttgttatattttacaactttcgaacaaaaatatagcatcgaagactccacatctgccatacatggaagatctctggcatcaactgctttgtatagattttcgatcatattttcattgtcgcattccaaatatctgtgatctgtctttgcatgatcaaccatcttatcaacccatgggcggtcttcgcttggctggaaggcgtttgatttaaaatatttatgattatttacaaaatcaaatgaaaatgtgtttaaattttttccttctttttgaagctttttcgcacagattgctgtgacaagactactgtccactccaccggataaaaatgtactgattggaatatcggataacatctgcatttccacggcatcttttactagccaccttgtatgctcgatcgtatctttttcgctgtctgtgtgttctttcgctttcaattcccaatatgcacgatctttcagcccttcacgatcgtattccaggaaatgccctggaaggacttcataaatatctttgaacactccttttccatatgactttgcaggtcccaacccaaagatttcacaaagtccttctctgttgatcactggtttgactcctggataggcaaacaagcctttgatctcagatgcaaagattaatgtatctccccgttttgtatagaataatggcttcacaccaacacgatctctgatcaaatataatttcttccgtttcccatcccacagagcaatagaaaaaattccattcaactcttcaatataagaaatcccatacctgatatacccggttaatacaacttccgtgtcactcgttgtcgaaaacatttctccttctttgatcagttgttcttttaacgttttcatgttataaatctcgccatttaagatgattgcgtaggtatttccttctttctttttacacattggctgatgtcccctgtaaaggtcaaggattgacaatcgtacatgccctaatgcacagccattttccaaaaatatcccttcatcatctggacctcgatgtctttgaacttcattcattttctttaagatctgatatatttctttctctgtttttttatcattgtttctaggatttagaaatcctgcaattccacacatacacgctacctctttttattttttatgatcaatgagaaccggctggtattgtctgccttttaatgcctgcaaaattgtcggaatgagcagtcttgtatccgcgatcatggagtttggcttctttaccggatcatcctgtccgaatggtacaaaataaatatgcttatgatttaaaagattcccgatattcttaagattcatacctaaggcatcattgctcgccatagagataacgactggtttttcattccgcagctgcgctttagctgccattaaaaccggggtatctgtaattccattggcaagtttcgccatggtatttcctgtacatggcattaaaatcaggatatccagacaccctgtcggaccgatgatttctgcttcttcaatcgttttcatcggttcatttcctgtcatatcgtgtgctctttttacaaattcctcaccttttccaaacctgcatttgatatgctgggatatgtcagaaaagatcgtctgcaggatcgcaccttcttctagtaagcaatcgatctgttcaaaggcttttgtgtaagtgcaaaaggaacctgtcattgctactccgattcttttatttttcaataccatgtttgatctctccactgatttctaaaactttttttgcaagcatgatcccagaagatttcggggaataaatgcctggaagacttgggcatagttttgcacagattcctagtttttccgccatttgatggtttgttccaccaggataggaagcaatatctatgatacaggattctttggagatcttcctgaggatatcttcttttaggatctgttttggaacggtattaaaaatatgatcatactgacagatccgccgttttagttccgtaaaatccataacctcaagtccaaaagattttgcaagacttcttgctgttttatttctggcacagactgttacctgagcatccattccttttagtttcgctgcaagaacttttgcacatcttccatagccaaggaccagacaacgacttttgtgaagattaatcggctgcatcttgattgcttccatgatcgcaccttctgcagttgcgatcgcattgtagatagcgacatcatccattttcatgaagtcaaatgctttgatttctttttgttcacattcatgtcgaatttcttcattgatacatcccccaaataaaatctgttctttcgtcatttcttgaagcagtgtttctactgacatttttttgttgatagaacttcctgtgatttccccgttttttgaaaaaacgacggggccaataatgcactttgcttctcttatgacattttcaaaagatttaccttccttgcattctgatccttcttttttggttgcatatgtgataacctgatatctttgattttttagataattggctaaatatacctgtctcatatcaccgccgataacggcaaaatcataaatcacagtcttttttcctttcttttttcttctatttaatatatgtgatttttattcattttgttcttttaaaaatacatcaattttacccctttaaaaattaaaaagtagtgatataataaactcaagtgcatagaaacacctacaatacagcaagagcttccactacactgggagctctttttgtgtatttatatattttatacacaaagtacttccggtgttataccataacatgcataatatcttaatgttttttcaaggaggaactttttatgaacacattaactgcagaaaaaagagatttgaaaacaaaggctaaaaaattaagaaaagaaagttatgttatcggaaatctgtttggcagagatatcgaaaattccattccattgaaagttgattcccgtgaagccgctaaattcttaaaggataacaaaaaaggtgctcatattactttacttgttgacggagaaaatgtagacgccatcgtaaaagaaatcgactacaatgccatgaaaaacgaaacaatgtttattaacttccaggcattagttgctgacgaaaagatccacacaactgctgcgatcgaattattaaacgaagatgctgtacagaatggtatcgttgaacagtccttatctgaaatcgaatacaaagcattcccagctgatatcgttgaaaaggttgagattgatttaacacagtacaatgttggtgatatgatccatgtcaaagacttgccattagctgctaacagcaaaatctctcttgttacaccagaagatactctggtcgttaacatcgcagaacctgaagctgttcctgaagatgaagacgaagaagcggctgaagaataaataaatcagtgaaagaaaagactcgattttcataattaaaaatcgagtctttttattttgccttttctttgatatcctttaaaaaatccagcattttttctcggatgtttttctctgcattctgagatcatcaactgaatcttaaatttaaaatcttcagattccaagatcgtaaatggatgttcttctgttacacaaaccgataaatgttcgctctcatattgtggataagatcctgtaaatccttgttctttcagttttttatcaacctgttccctgtatcgttgaatcttctgatcgattctttctccataattccttgctggatatggatcagaagcattgcagactttctcgcagatcaattcatataaatcttgtctctttggatcttgcagtttctttgcaagcgtcatctccattcgtttggttgggtgcttctcatatttatcgatccattttaaataatctttatcacctgcctgcatagcaagatttctcatacattctaatccttcttcggttttgtcataccattcttctggatcttcattgatcggaaaatagtaataaaatggtgcaaattcgatcagtgacatgatctccatctcttgatcattacacacttcttcccctaaaaagcgatatttctcacggatcgttccaatcatatagactagctggcgccactgctcagctccatctctccagaaatgtccaatctcatgataccggtaacagttcgtatgttccatgatctcatcaaaccacattgtaaaaacactttcttctccctgatgaacgatcaacccataacgaccttctcgttcttccagttgtgcccacatctctccttcatagtctttgtcatattttccagagatacgaagtccatgaaaacttagataacactcaattgcatcgttcatcatatatggaacatatcctgtttgatttccatctttttcttcaacttgaagttcaaacacctgatattcaaaaatctgtgcaagcaactgtgttgatcttgatatttcttctaaatttgtttcaaaatagttcatacggaattcctttttcctattatctatgtattttatttatatttctgaatttcatttaaaaaacgttcgccatatttctgaagcttatgttctccgactccattgacttctaacatttcctcatcattagaaggtttcatcgtactcatatgtactagtgtcttatcggaaaataccatatatggcgggattttctgttcggatgcgatcattcttcgaagtacacgtaatgcttcgaacaattctgtatcttcctcagcaagtgctgccacagcccctgctttcttacgtttcttcgtctgaatcttgcgttcttctttctctttttcgacttcttttggaatcttgatctcaaagttccagttatcatcaatcttagtaatatctgcaacgcttaaaaccggatattcatcatctgtcatttccagatatccatagactaacatttcattgatgatctgtcgtatccttgcaatgctttctgatgccaatgctccatattgtgaattctcatctaaatgacggcttaatactttctggctctttgaaccttttaaaatatccacgatcgttgatagtccgaaatctcgataacaatctctaatacattggatgatagctttcgcttccattgttgcatcaaccgtttcaaactcggtcagacagtttaagcagtttccacagtatccgcttatctgttctccaaaataatttaaaatataatgacgtaaacattccttcgtatagcagtaaaatgtcatctgacgaagtctttcccaatctctttccatcacgatctgctttgtgatcgcatctaattcctcattctcctctccattttcgatcagaaaacgattggttcggttatcaatcggcgcataatataagatacattccgcaggttctccatcacgtcctgctcttcctgcttcctgataataactttccatgttcttcggcatattataatgaacaacaaaacggacatccggcttgtcgattcccattccaaaggcatttgtcgctaccatgatctgctttctgtcatagataaaatcttcctgattttcctttcgttcttcatccgataatcctgcatggtatcttgtcacggagaatccatcttctcttaactgatagcagacttcctcaacatttttcctagataaacagtaaatgatcccgctgcttcctggcatcttttcttctttttcttttaaataacttagtaattctctatacttatcccttggacgttttactgcatagtaaagattctcccggtcaaaccctgtcgttaatacaaatggatctctcaggttcaaaatatccataatatcatccctgacttctgctgtcgctgttgctgtatatgcagtcagtacaggacgatacggaagtttctttaaaaattccaaaatctttagataacttggtctgaaatcctgcccccactgagacacacaatgtgcctcatcaactgccaacattgatatcttcactccactatttagcgcaaaattgataaaaccttctgtttccaagcgttctggtgccacatagatgatcttgtatcttccctgcatcgcatattttaatgcggtatgatactgtccctgtgtcagagaactatttaaaaatgccgcatgaattccagcttgattcagtgtcccaacctgatctttcatcagcgagatcagtggagagatcacaagtgtaattccatccatcatcaatgctggaatctgaaaacaaagagactttcctgctcctgtcggcatgatccctaagacatcctgcccatttaatgctgcctcgatcaattgttcctgaccttggcggaattcatcgtatccaaagtattgttttaatagtttcttcgcttcttgtatcttactcaaatctatcacttcctattgttttatttatactttcaacactctcatcatttatattcccacaagaaagaatcctactttgtaggattctccgcctgcggcgggtcgcttcagcgacaaatttcccttccgccgcagtgcgatcctgcccggagggcttttttatttcataggggatttcattgaaatttcctatgaaataaaaaagcttccaatcacatttagcacacccgcaaacagcatgacaatgatcggatcttttttctttctcaataaaaggtacatacaaatgataaaaatactaccctgtatccagttgatctgttgaagatctatatgactttcctgaaaaaatgcctgcgtaaggatcgtaattccagaagttaagatcagtgcgatcaccgcaggacgtaaggtatttaacaccatttgtagtccttccatatgacgatattttacataaaaataagcaatcactgtaacgatcacacacgccgggaatacgcatcccatcgttgcacataatgctccttgccatccaactacccttataccaacaaaagtcgccgcattaattgcgattggtcccggtgtcatctgtgaaatcgtcacgagatctccaaattcagatacagacagccaatgatatgcatctaccacctgctgctgtatcattggcattgctgcatatccgcctccgaaactaaatgctccgatctttaagaagcttaaaaataattgcaaatagatcattctctgcctcctgtcttctttcttgaaataccatattgtacaattccaactccaatacatgcaagaataatgtagatcacactaatattaaagacataacttgccataaatgccacaaccataatgatcgcaagttctattctgttttccttcttactttgcccttttgccatctcgtacacaacactgatgatcaccgcaccaacacccgtctgcataccagaaagcatcgctgcaacaatcctgttatcccgaaatatttcataaaaaacagagactacagatatgatcaaaaatggcggtagaacagctccgaatacacttacgatcacaccactgatacctgctaatttatagccaacaacgattgctccattcactgcgattgctcctggggctgattgtgcgatcgccaccagatcaagcatctcgtcttcttcgatccaatgatattcattcacaaacttcttcttcatcaaagatacgatcatatagccgccaccaaaggtaaatgcacttaaataaaatgtttctataaacaacctcaataattttttcttttttttcattcctttttcttccatatgacatctccagtcaaaaatcttaccatttatactggtgcaaactggctgttatataatctggcatacgcaccatttttcgctaaaagttcttcatgtgttccctgctccaaaatatgtccattttccataacaagtatcacatccgcattctgaatcgttgaaagtcggtgggctacgataaaacttgttcttcctttcatcatcgtttcaaatgctttctgaattcggatctctgtcatcgtatcaattgatgatgtcgcttcatctaagatcagcattggaggaaggcttaacatgatccttgcaatacaaaggagctgtttctgtccttgagagagatttccgccaccttctgtaatgatcgtatcataaccatctggcattcgctcgataaatccatgtgcattggcttcttttgctgccatgatcatctcttcctcagttgcatctggttttccatagcagatattttcacgaatcgttcctgcttttaaccatgtctcctgaagtaccattccataactggatcgtaaactttctcttgtgacatcccggatatcatttccttccaccttgatcattcctacattcacatcataaaaacgcattaacagattgatcaacgttgttttcccacatcctgtcggtccaacgattgcaatccgctgtcctggttccactttcagattaaaatcctggatcaaaggtacttctttcacataagaaaagtccacatgctctaattctacatttcctttcacatcctgtaactccttcgcatctttggcatcaggaatcatcggctcctcatctaataattcaaaaactcttgccgcagacgctaaagaattctgaaattctgtgataacccctgtgatctcattaaatggctttgtatactggtttgtataacttaaaaaacttgataactgcccaacactgatacttccgcgaataacactcatacatcctgcgatcgcaacccctgcatagattcctgaatacataaatctggttgccggatttgtgatagatgagaaaaatgtcgctcttaaggagtaatatgcaagatcatcattgatctgatcaaactcttcctgtgctttttctccatgatcaaacactttgactactttaatatttccaagcatttcattgacaaatcctgtcatatttcctctagtctgtgattgtttccggaacatattaaaacttcgctttgagataaaacttgcgataaaaaacgaaaacggactaaaaataacaacgaccaatgtgatccatggattgattcctaacataaaacaaatggttccaatgatcgtgatcacaccagtaaataactgtgtaaatccaagcagcaatccatccgtaaactgatcaatatccgttacgatacggctgatcaagtctcctgaggaatgtgcatctacataagataatggcagtttctgcaaatgctcaaatgcctgaatccttaaatcttttccaatcttatatgtaatctggttattgacatgattcatcagccactgcgctgccgccgtcaatgcgatacagatcacgatcatttttataatacttatcaatcttgcaaaatcaacatttccttttgatataatacaatccacaccttgtcctgtcagaatcggaacataaagtgtcagtgccacactgatcaccgccaacactaaagacgcaaagatcaaaaatcgataaggcttcatatattccatgatcctttgtaatgtcttttgttttttgtctttcttcatgatcttatgcctcctctcctgccatctgtgatgcgcagatttctttatatacctgattctcttttaatagctgtagatgagtcccgattcctgcaatctttccatcatccaacactaagatatggtcagcattacgaatcgttgatactctctgggatacaagaaatactgtcatattatctgtattttctttgatcgcttttcgaagtcttgcatctgttgcaaagtcaagtgcggatgcactatcgtcaagaattaagatctcaggtttacgtactaatgctcttgcgatcgttagtctctgtttttgtccgccagataagtttcctccattttgttcaattctaaagtctaatccctgttccttctgatcaacaaattctcttgcctgtgcgatatccaatgcctgatagatttcttcatctgtggcatcttctttaccccatttcatattatctcttaggcttccttcaaacaaagatgctttctgcggaacaaatccgatctttcctcggataaattctggttttaattctttctcatcaactccacggtatagaattcttcctgatgtcacatcatataatcttgcgatcaaagatacaaaagtactctttcctgaccctgtacctccgatcaccccgatcgtttcgccttctttcaccgcaaaatcaaatggatgaatcgtctcttttcttgcactatgatagacaaacgatgtatctttaaactcaaggataggtgtatctttcttctcttctatatctgtttttccagtttccttcatggatggctctaatgcaaaaatctgatccacacggtcaagacttgcaaacgctctagataagatgatcaaaagattcgcaagttttacaagttctacaaggatctgtgacatataattgatcaaggcaatgatctgtccttgtgttaaataacccagatcaacctgttttccaccagaccataggattgcaatgatccccaaattaatgatcatgtaagtcagaggatttagtaacgctgaaatctttccaacgtggatctgtttgttataaagctgtccactttgtactctgaaattctcttcttcgcttctttgtctgttaaacgcacggatcacacgaattccaagaagattttcccttgtactttttaatactccatcaacctgtttttgtactttcttatacattggcatcgtgatccataagatcagtccgacaactactgccaatgctgtgatcgtaaatacaaaggaaatcgctgccttatgatccaccgtaaatgccatgaacatcgcaccaaatacgacaaatggtgaccttaaaaacaaccgcaggaacatgttaactccattttgcacctgattgatatcattactcatgcggttgatcaacgttgatgtcccaacctgatcgatctcctgataagaaaatcgattcatatgtgcaaataaatcacttcgcatcgactttcctgtatacacagccgatcttgccgcaaaatactgtgctgtgatagaaaatgaaaatccaatgattccaagtaagatcaataatcctcccatcttccacaaatacccaatatcgtgatgtccgattcctacatcgatcatgctggcaacgaccaatggtacaaatagttcaaaactagcttccaacatcttaaataatggtgcaaggatcgtaacgcaaagatgctcctttaaatatcctagtaaccgtttcatcgattcgtactccttcttttatcttactattttctttagtatacaccattttattttttatttgaacatagtaccagatattttacgaaaacaaaaaagtaccgcttagagccaggtaacatgctctaaacggtacggggatgatttatggttcaaaaagagttatttgtcttccttttgaacagaacaatatccttgtgggtggctgctgtgccatttccatgcggatgcaatgatttcttcaagatctgcatgttccggcttccagccaaggatattcttcgctttttcactggaagcgatcaagacagccggatctccagctcttcttccttcttccacagccttgatcggctttcctgtcacttttctggctgtttcgatgacttcttttacagtaaatccaacaccatttccaagattgaagatgttgctttcattaccttccattaagtatttcactgccagaatatgtgcttgtgcaagatctgttacatgaatatagtctcttacacaagttccatcttttgtatcataatcagttccaaagatactgattgcttctcttttgccatttggcacctgtaagatcaatgggatcagatgtgtttctggattatgatcttctccgatctgtccacttacatgtgctccgcaggcgttaaagtatcttaaagatacataacgaagtccgtgagcacgtccaacccatttaaacattttttccatagaaagttttgtctctccataagtgttggtaggttctgtgcggtctgtctccacgatcggtaccttttctggttctccataagttgctgctgttgaggaaaatacaatcttatcgataccatgttctactaaagactgtaccattgtttttgttccacaaaggttattatcataatattttaatggatttaccatactttctccaactaaggagtttgctgcaaaatgaatgactgcatcgatatctttttcctgatctagtacactatctacaaaatctttatctcttaagtcacctttataaaactttgcttttggatgaacagcctcgatatgtcctgtttccagattatcgatgatcacaacttcttctccagcatcgatcagttcgtatactgtatgagaacctatgtatccagctccgcctaatactaatattttcattgtcttgctttcctttctatgaccttgtcattataaaactgcaataaatcggtcgaatgcttttcttccttcttcattatatttataaactccggcatcttcaagaactttaacaaatacctgtccaatctcttcctttaagatatccatgacatttccttcattgatatctgtatattttcctttgatttcttcaacccatgctgcatgcttctttaaatcttccttagaaacaatatcttctcctttgatcagacactggcttaaatgttccatctctgcctttaatctagatggcagaacagcaagtcccataacctcgatcagcccgatattttctttcttgatatgatgatactcattgtgtggatggtaaagtcctaatgggcactcttcagttgtgatattattacgaagtgtcagatccagttcatacatatcaccttttttacgtgcgatcggtgtgatcgtattatgtggttctccttctgtctcagcaaaaatatatgcttcttcatccgtgtatccacgccattttttcaaaatatgatcagcaagatcaatgaggcgtttttcatctttactctgaatacggatcacagataatggccagtgaacgattcctgctttgacatcttcatatcctgggattgtaaattctttttcaatctctgctcgttccatagcaaattcataatgaccgccttggaaatgatcatgtgttaagatagaacctccaacgatcggaagatcggcattcgatccaaggaaataatgaggaaactgttttacaaaatcaaatagttttgtaaatgctgcccgatcgatcttcattggtacatgctgtccattaaatacgatacaatgctcattgtagtatacatatggagaatactggaatccccattttctgtcattgatcgtaagcggtatgatcctgtgattctgtcttgcagggtgattcattcttcctgcatatccttcattttccatgcaaagctgacactttggataagaactttgctttgcatttttcgctgctgcgatcgctttcggatctttctctggtttggagagattgatcgtgatatcaatatctccatatggactatttactttccatttcatatcttttttgacgcggtctcttcggatatagttggtatcctggctgaattcatagaaaaactctgttgctttctttggactctcttcgtaataggtacggaattctttgatgacctggcttggttttggtgtcaggattcccattaattttgtgtcaaataaatctcttgtcacgatatcatcacttttgatgatatagcgatcataagctgtatctgtcagacgatctaaaatctctggcaggatgatttcttctccttcaatatcaggatcttcatattcatctaatcgaaacacttccagatattgattgatcgtatagatttcatcttctggcatgatcagttttttatctagtccatatgttacaagttttttgatatctttttgtaaatccatcttattccacctcaaatcgatatgttgttactgcttcgtattcttcgccttttcttaaaattacctttggttctttttctatatgtatggagtttggtaagaactgggcttctaaggcaacaccatctctgttttcgtatggtttcccaccttttccattacatccgccagacaggaagtttcctgtgtatacctgaatgcatggaagtgttgttgtcattgttaattttcttccagtttctttgtcatataggatcaactggtcttcttcatcttttaccatgaaagaatgatcataacctccggcaagttttaactgttcatgatcatcgttgatccgctctccgatctcatgaaattctttaaagtcaaatggtgtgttttctatctttaaaaatgttccattggcaagacagttttcatcaacacatgcaatctcatccgcttttacctttaactgatgatgataaattttatcttttccagcagataaattaaagtaagaatgatttgtgatattgatcagtgtatcctgatcggatactgcttcatattccatttttaatgtattatcgcataaacgatacacaactttcagataaagatttcccggatatccttcttccatatctggtgagagatagataaaacggattccatcttccaacaattcatatttaaatatcttttgattaaatcctttgattcctccatggagagaattctttccattgtttgctgccaattcgtatgtctttccatttaattcaaactttgcatctccgatacgatttgcaacacgtccggcgatcgctcccatgtaacttccatctccatgccaacaatcttccacattctcaaatccaagaacaacatccccaaagtttccttctctgtcttttgtaaatacagataatacatgacatccaaggttacttgtgatcactttgatctcatcattttttaattcgaataagcagactccgttatctctttgttctatcattcttactttcatcatcttataataccttcattcctccgtatggacgtacttttaagacatgacatgctccttcaccaaatacatgttccatgttctttttgtacatactaacaatatcatttggcacaaacgcctgaatcgttcctgcaaatcctccgccatgaactcggctgactcctttatcacctaaggaaatatcactgattgccaatccgattgatacactctgatttgtcaaatcatgacttgaatatacattttgtaaatatttaaaggatgaatcaccagattctttgatcaatttcttaaatgtatcaaaatctccttcttctaaagcttttacctgctgatctacacgtttattttcctcaaataaatgcattgcacgaagaactgctctatctcctaagatttctctgatctttggcagatttaaataaaaatcatctttatcaacttctcttaatgcttcctgattaaaataattggcaactttcttcatttcgtatggaattgctgcataatcatctgttaaatctgcatgagatccttttgtatccacaatgcataagctgtgtccatattcttcaaaatccacttcaacctttttgatctttggactttgaggatcttcaaaatcaatattgatcagacctccaatggaagatgccatctgatccatcaatccacatggttttccaaagtatacattctctgcatactgtccggcctgcgccaaaaatacaggatcgatcttcatatcattatataacccagataaaatatttccgatcaatacttcaaatgcagcagaagatgacattccagccccatttagtacatcacttgttacataagcttcaaatccaccgattttatatccttcttcttttaatttagaagcaactccctgaatcagtgcctgtgatgttcccttttctgctttggctgggtcaaaagaactaagacttactatgattctttcatatccttctgatttcagatcaatcacatcgtcatctctttttgcaacgattgcgatcgcatccaagttaatggaagttgcaagaacttttccaaactgatggtctgtatggtttcctcctacttcacttcttcctggagcactatagatttctacttctttttctccataaatatctttaaaggattctaatgctttgatataacgttcctgctgatatgcaagaacactttcatctacatagatatcttttaataactgatcatatttcccttctttaaaagcttcttctaattttttaatactgttcggcattgcgatttgctctcctttcttcgattgtctgaataactttcttcatgaaactgtcatccaaatgataggcttttttataaactacataggctacaagcatggacaccgctgggatcgcacacattaaaaatcgaatagaatttaatgttaatgcagactgtactgcgtttggatttggaatatatcctgtacgttccagtgcaaatccaatgaaaagtgatgttaaagccgctgtgaattttacgatcaatgtctgtaaagagaatacaacggattcatttcttgttcccagtttgtactcaccatagtcaacgacatcagataagaatactgtcgcacatccaagttctaatcctgttcctgtctttacgatcactcctgcaactgctgttaatacgatattctgtgggcatacaaatccaacgactaataataatgctaaaccaataaatggtaaaatacatgccagtaaaaatgatgtatgtctggataatttctttgctacttctgggaagatgatcaacccaacaacttctgcgatagatgcgctgatcatgaaggctgataacatgttggcatttccacatacatatgtaaagtagtaaactgcaacacccatgataaactgaattcctacattatataaaagaatcagtcctacagctgactgtaactggtcatttttcttaatgattgagaatacatctttgaaagaaatcttctcacttggtgcattgttttctttgactttcaggttacaaactgcaacaccgatcgtaagaataaatgttcctgcaatgatcatagcaaaacgatgatatccgatatatcctccacctaatgctgcaatgatctgaacaccgaatcctgcgatgactaatgactgtccaatgcttgcgaaaattctaggtaaaacggaaacaacttctcgttcgtgtggatctgatgtaaggtttggaattacagaccagtatggaatatccatgatcgtataagtcattccccataatacatagatcactgcaacgaagatgcaaagtgaagttcctgttaatttaaagtcagtaaataatacgacaaacacaacggaattgactaaagttccgatcactagccatggtacgaattttccaaagcgtgatcttgtgttatctacgatcattcccataaacagatcgttaaatgcatcccaaagttttgctacgaagaaaacgattcctacaaaccccggtgatactttcaatacatccgtaaagtagatcatagcgaatgtcgccatcattccataaattaaatcttttcccaatgctccaaatgcaaaagtatattttactctgcctggaacctttccattagttgttcccatttttctttcctcctgtttttagtaaactgtctttgatacttgtatagtaaaactttttagtaaaattgtcaatatatttttactaaattttttacttttattttactaaatttacttttgtgcttttctctgttataatgagataaattaatatttatgagaaaggattttatctccatggcaacaatcaaagacattgcacagaaagcatctgtttctgctgcaactgtatcaagaattttaaaccaagacgataccctgagtgtaaccgacgaaacaaaacagcgcgttttaaaggttgcccaggaattaaattatacaaagcatctaaaaaataccgttgaaaaatcgatttctatcggtatctttcaatggtattctgtctttcaggaactggaagatccttattatcaggcaatccgtgtcggtattgaaaaatattgtgccgatcataatatccacgttgtccgtgctttccagagcgattgcaattatcctgacacactcaaggatcttcaaggtctgatttgtattggtaaatttaataaatctcagattaagtcttttcaaaaacttaattccaacactatttttgttgatatgaagacaccaaagatttattgtgatacgatcaatcttgatttccaacaggcagttactgaagcattagattatttgtatgatcttggccatcaaaagattgcttatcttggcgggaaggaagttctcgctgataacagtgtatattttgaagaacgtaaagataccttcatcaacttctgccaggaacattccattgaccataaatcttttatttatgagggagattattctgctgaatccggatataacatgacaaaacaaatgattgctgatggcgaccttccaaccgctattttctctgccagtgatcctcttgcaatcggtgcaatgcgtgctttatatgagaatggttataaaattccagatgatatatccatcattggttttgatgatatcagcgttgcaagtttttcaaaccctccgctgacaacgattcatacaccggctgaatttatgggagaatatgctgctcattatattttacttcggacaaaagaagattctctggagcagcagactccgattcgtctgacacttccatgtaatcttattgtccgtaactcttgtgctgctccgcgcaaacagtcataatatttagtaatatttttacttgtttttctaagcatagaaaaaactgcatgctaaccgcatgcagtttttcccaagaaggagtaaaaagttaataggtaaaatttatttatgaaaatggattctcagtcttataaagcatattctttggctgattaaatccaatctcatcgacatcaacaccaatgtatttgaatacttcatataaagtttttccaaaatgaccaaaagcaacagctccatggtgtgggaaattcttttcgatcagtacatggcggtaaaatcttcccatttctgggatagcaaatacaccaatagatccgaaagatcttgttgctactggaaggatttctccttgtgcaacgtacgctcttaattttgtatctgctgtactttgtaaacggaagaatgtaatatctcctggtgcgatatcaccttctaatgttccctgtgtcacttcttccggtaatgttcttgccataatcttctgatatttcatctcacagaaagataatttagattttgctgtgtttccacaatggaatcccataaatgtatctttttgtgtatagtcatagttatctttaatttcttcattatacatatctgctggtacggagttgttgatatctaataatgtcacagcatcctgacttacaaccgttccaataaattcgcttaatgcaccatagatatctacttcacaggatactggaattccctgtgctgccaaacgactgtttacataacatggtacaaatccaaactgagtctggaatgctggccagcattttccggcaattgttacatattttctgtaacctttatgatccctgatccagtcttttaatgtcagttcatactgtgcaagcttggaaagaatctctggttttttatttcctgcacccagttcttcttccatttcttttatgattgcaggaattctttcatccccttcatgctgattaaatgcttcaaataaatctaattctgagttttcttcaatttcgattccaagatcatataatggtttgatcggtgcattacatgcaaggaaattcagtggtcttggtccaaaacttatgatcttcaattcacttaatgcttttactgttcttgcgattggcaaaaattcatggatcatatctgcacattcttctgctgttcctactggatattcaggaatatatgcttttatatttcttaatttcagattataacttgcatttaacattccacaatatgcatctcctcttccatctaagaggttatcaccactttcctcagctgctgccacaaacatctttggtccatcaaagtgttttgcaagaagtgtttctgagatttctggtccaaagtttccaagataaacaactaatgcatcacatcctgcttttttaatatcttctaatgcctgtaccatgtgaatctcactctccacgatacagactggacattcataaatgtcctcaggatcatatttttctttatatgcttttatcaatgcttctcttcttgtaactgataaactttctgggaagcagtcacgactgactgctacgatcccgatctttgtttttggcatattattcatattgttttcctcctttaatacatcaaccaaatataactatctacttttcattaccttgtgcaagacgcttctcacgaattgatttaaatacactctgtaagattacgaagaagcaaagaagtaatgcgatcacgattcttgtccaccaggatgataatgttccctggaatgtaatgatcgtttcaatgatacccttgatcagtgatccaaatagtgatcctacgacagttccaacacctcctgttaaaagtgttccaccaataactgctgctgcgatcgcatccatctcaaatcctctggcctgctctacgaatccaccacaagagtttaagcagaaagcaaatccagctaatgatgctaaaaatccatttaacacataaacttttaattttgtaactttaggatttaatcccattaataatgcagactgttcatttccacctactgcaaatacggcacgtccaaattttgtgtatcgaaggatcacaaaggaaatcgctacaaccaataatgcaatgacaacacttaggtagatataaggatgcattgcaactcctcggttgttgtaatatgtaataaatccaaaataaattcgatagtttgcaagacttaaaaatgttggattttcaatactgatcatatcggaactgatcaatgctgtaagacctctggcaaagaacattcctccaagtgttacgatgaatggctgtatttttaaataagctactaaaaatccttgaaccaatccgaagatcacaccaaatgctaataccagaataattgcaacgactgcgctcatatgcttcacttccatcatccatgcaagcatcatacaaacaacaccgatgacggaaccaatcgaaatatcgattcctcctgtgatcagtacaaatgtcataccaacggctgcaatgatcaatccagcattactaatgaacaagtttaaaaacacctgtgggcttgtaaagtttcgatctccgtaaaggatcgcacctgcaatatagagcacgaagaataatacgatcgtaactgcaagcaaaaatccatttcctctaagtttatttttaattttctctaccattgccattatgccaccttctctccagcagtttttgctgcacgttttgctttaatacgatttaagtatttcttaaattctggagactgtaatgtcacgattatgataaccacgatcgctttataaagtggaagctgatctccagttactttcattgcatataatgttgtagataatgcctggatcgtgatcgctccaataacacttcctgcaactgagaatttaccacctgcaagagagtttcctccaagtgctactgctaagatcgcatctaattccatcaagtttcctacgttatttgcatcaatggatgtgattcttgatgttgcgatcattcccgcgattcctgcacaaagtccgcaagctgcatatgtgataaagatgatcttcgtagaattcagtccaaacaaacgactggctcttgggttgatacctacactttcaatatacaattttgttgctgtcttatttaagaataatgttgctaaaatgactacgatgatcgctaccagaatcggtgttggaactggaatatgtggcagaaatcctcctaaatacttaaagctgtccactttgacatataagttatttccacctgtgatcaactgtgccattcctcgtcctgcggtaaataagatcaaggttgctaccattggctggatcttcatattcgcaactaagaatccgttccacataccacataatacagataccacaagcccgatcaggattgctgcgatccaaggaattgcatatgtttctccacttccaagaagataaacagatacagctcctgataatgccatgatcgctccgacagagatatcagttcctgcactggatgctacacaaagtgtcataccaactgctaagatgatcaattcactggatcggttgaaaatatcgaccagatatccatataacacaccatttttaattgagatttcaaaaaatgatggggattttataaggttaaataataatacaagtgccagacatacaattggccagaagaggcgatatgatgtcatcttttttaatttatccataattatttgtcacctcctgcaattgctttcattacattttcctgtgataattcactttcttccaattctccgactttctcaccatctcgtaagattcccatgtgagtcacggtacgaagcatttcttctacttcggatgaaataaatacaacagacattccttcatttgcaagttttacgactaatttctgaatctctgtctttgttccaacatcaatacctctggttggttcatcaaggatcaggaaatctggttctgtcatcagccatcttccgaggattactttctgctgattaccaccacttaatgatttgatcggtgtttctctgcttgctgtcttaacctgcagcatcttaatatacttatctgtcaactcttcctgttcttttctgctcatcagtttgaacattcctcgttttgcctgaagtgccaagatcatgttttctcttacagaaagatctgcaatgattccttctactttacgatcttccggacaatatgccattcctttatgcattgcattaattggtgctttgacatctaatttttctcctttgacatataattctcctccatctggtttatctgctccataaatcgctcttacaagttcggaacgtccggatcctaataatccagataatccaacaacttctcctttatggatcttaatgtcaaatggtttgatcgttcctttatgataaagaccttttgcttcgatcacaacttcgtcgctttgtttctttgatgatgttccacttcctttgatatctgccagatcatcaaattcttttcccatcattgttgcaactaatttaaatcttggaagctcttctgtcttatattcgcctacaaaatgtccatttctaagtactgtgatcctgtcacagactgcatagacctgttccaaaaagtgtgttacgaatacgatcgctgttccgcgtttctttagcatattcataaccttaaataatttctcaacttctccttcatcaagacttgatgttggttcatcaaggatcaatacttttgactgaatgtcaactgctcttgcgatcgccaccatctgctgaatcgctacggaatagttttccaattcctgtgtggcatcaatttctaattccagattatcaaggatcttctgtgcctgtgtattcatcgtcttccagtcgatcctccccattttcattggttctcttccgataaaaatattttctgctaccgttagattcggacacaggtttacttcctgataaacggtgctgattccattgtttcccgcttcttgaggggatgtgttaataatactttttccatccatgatgatctcacctgtctcaaattcctcaactcctgtaagaactttgatcagtgtagattttcctgcaccattttctcccattaaggcatgaatctctccttctctcaatgtaagctgtgcatcggacagtgctttcactcctgggaatgttttattaatatgtcgcatggatagaactgtcttcttttcatcactcatgacaattctcctttcttttcatgatttttgagccgattttaatgaaaattccctgatttttggcataaaaattacaggataagtcagattgtcctgacccagagcctgcaatctttatttgtagtgcgattgttaatagttacatgtgtgtacttaaggggattttcaacaatgtttattaatatgcacgtttgttaataacttcttttgtagtattatcttttgtaaatacctgctcatctacatactggatcttatctactttttcacctttcatgatcttcttagctaattcagctacacgaggtccatgaagtgggttacattcaaattcagcattgatctctccagactgaactttctttaatgctgctttgatcgcatcgaaagaaatgatcgttacgtctttaccaggtgtttttcctgctgcttttaatgcatcgattgctccgaatgccatgttatcattctgtgctactacaacatcaatgtctttgttctgttttaagaaagattccataacttcctgaccttttgcctgtgtaaattctcctgtctgagaagcaatgatcttgaagtttttctgatctttgattccttctttaaatccttttgtacgtccgatttctgcagaagaaccaatcgttccctgtaatacagcgatgtttacgtcacctttttcttttcccttttctttaattaaccattcagccgctttcacaccttcttttttgaagtctgatccaacccatgctgtgatcagtgaatcatcagaagttttgatctgacggtcaactgtgataactgggatgtcagctttctttgcttcttttaaaactgtttcccaacctgtttctgttacaggtgcgattgcgatcacatcaacaccctgtgtgataaattctctgaccgcttttgtctgattttcctgtttctgctgagcatctgcaaatgataatttaaatccgttctttgctgttaatgcagatttcatagactttgtattcgctacacgccaatcactctcagctccaacctgtgaaaatccgatgttgatctctgaagtttccttctttgaagaaccactgtctttcttgtttcctccaccacaaccagtaagcattgttccaatcatcattgttgcaagtaaacctgcagccaccttcttaatacttcttctcattatgatttcctcctttttcttttttgattttttcgttttccttaattacaagttatattttacttgaaattgtatttctttcaatgcaatttcttttgcattcggtggattattttatgaaatttttatcttgtctgtttaaagtttgattttttttgataatggtttgaatttttttgatttttgattattttttctctgcttgtctagtcttcggtacaactacgatcaccttagttccaatatctggttcactttcaaggatcaacccatattcttctccataatataatttaatccgccgatttacatttgcaattccaaaccctgttgtcctgtttacccatatatcttcatacatttctttattgatctgaactacctgctcaggctgcataccaactccattatcttcaacgatcaggaatatattattttcatcatctacactggaaatctttatcattcctttttctctttgttttttcaatccatgatataatgcattttctactaatggctgtaaagtgatctttacaatatcatttttcttgatctcatctgggacatcaatagaatattccataatatccccgtatcttaattgttgtatctttaaataattttcaacatgctctaattcttccctgatcgttatcttatcttctccgtgacttaaacttgtacggaaaaagccagacaaggcagctaccatttctaccactttgtcatcctgatgatcaatggcaagccacatgatcgtgtccaatgtattataaaggaaatgtggattaatctgctcttgtagtaactgcagctctttttttcgaagattttgttgttctacttttacatcttcgatcaatctctctaccttttgtgccatatgttcgaaattatttgttaagatctgcagctcttctgttgtattttgaggtccatgtacatcaaaatttccctgcgccacttcctttgtcatctcacataactgtctgactggataactaatgctttgcgaaatcaatttcgataatttccatgttatcagagacaaaaacagtacagcgatcaatgtgatcgtgatcgtatgcatgatttctttttccagttttacacgcatactctccatattcccaatctcatagtaaatgtattcggatactttttctttaatgatctctgtaaatacattcacatttaatcttaatctctgattattttccatataatcgttttttagatctgagtgttcaatttcttcaatggaaatcttcagattatccaacagttttcctatctgtctcgttcttaatttactttcatctgttaccgcatttttattcagttcctttaccagctccttcgcttccttaatctcctcatatggtttcatcgtatcaaaactctctgcaccgataacaatacgatacattttataatccatatcttctgaaaatgagaaattaaacttgctggctactgatacgttttttactgcctcattatagctttcattaaaatttatcatgataacaagaagcgtgataatccccactaacgcaggaattatcacgaccatccttaaccattttagttttttttctattgagaactgccgaaatcgagcaatagattctctcacatattttttcattacatcctccttgatctatattcacttggagtacatccttgcgtttttttaaacaggtagctaaagtaatgtggatccttatatcccacttcatagctgatctgtgatgccttcatatctgtaaaacaaagcatttcttttgctttatccattctgactgatgtcaaaaattccacaaaagatttccctgtttcttgtttaaacgttgtactaaaatgactgctgcttaatccaacctgatctgcaacatcactcaacgataatgtttcttcttgataatttttcacaataaattcttttgcctccgttatcaatgaagaatgtttcttccctaatctttcatttcgcattctgatcgcttgtatgataagttcttcgatatactccgctgctttctctcctgttgaaactgcagcgatctgttgtttgtaatccttaaacgtgcgatcgatatttgctttctcaactcccattttctcaacgaatttcataacacctacctgtatattgatcagcatatactgacaaaacataaaggaatccatattagattttcctaatgtcttggtatactcctctacaaataaatgtacagcttcttcttttccatttctcaaaaactcttccagcgattctgaatttactttggtaaaatctacttgctgcagatcttctgctctttctatcttttcattatctaatttatcaaaaaacaccgcttcattcccagaagactgatactggtatgcaaaagccttgcttgcactgtcgtaagattccgaaaggttatgtaatcgttccactgcatgtccaatccctgcaaaccattgtagttctttctcttttttcatacgctttgtcaatgctgcaacataatcttttgccacttgtatggtttcctctgtattctgtgccttgatcattaaaatatagccctctgttacacggtgaaaaacaatcatattttcaaactggctgcttacttcttctacgattgcatcttctttggtacgaagatcatatactgcctctgtatcattctcattctttgaaaatattttaaataacataaaattgtatgccggtgccataagatctattccaagttcattcccttgttccattaatttagatacagatatctttccgcggatcagattcccgaaaaattgatatctcatatttttcatttgtgtttttatatttttttgtaatttttttatatcttcttcctgtctttttttcttatcaagcttttgttttactttatttagtgcttctaataactgctcaccagttactggtttggtcagataatctgttacaccgatcttgatcgcttcttttgcatagtcaaactccccatatccagaaagtatgatgatctgtatttttggcatttttttctttaagatatcacttaattcaagtccatccataaatggcatcttgatatctgtgatcacgatatctggatgtagtttttcgatcattggaagagccatctcaccatctggtgcttctcccgcaaattcaaaaccattttcttcccattttacgttattctttatactcttacgaatgatcttttcatcttctactaaaaatactttgatcatattaccttcctctttcctaaaatattattatactctcttatagaattatattccagaaataaacaagaatatatccatacaaataaaaaggggaaggggatattgtatggatatgattcttattttttaatttcaatctatattattctgtttcaaatcggtatgttgtcactgcttcatactcttcgccttttcttaagataactcttggctttttctctatattcatagaattaggcaagaattgtggttctaatgcaacaccatctctgttctcatatggttttccaaatttaccatcacttcctcctgccagaaagtttcctgcatataactgcatgcatggaagtgttgttgtgatcgttaattttcgtccactttctttatcatataagactgcatgatctttctcatcctttaacataaaacaatgatcatagcctccaacgaatctcaactgttcatcatcatcatgaatccgttctccaatctcatgaaaacttttaaaatcaaatggtgtattctctacatccaaaaacttacctgttggaagaccattctcatctgcacatgcaatctgatctgatttgatcatcaattgatgatcatagatcttactgtcttttgctgaaagattaaaaaaggaatgattggctatattgatcagtgtgtcttgatctgacattgcttcatattccatctttaattcatttccagatagacgatatactatctttaaacaaagacttcctggaaatccttcttccatatctggagaaagatagataaaacggattccatcttctaaaatctcatagttaaaaatcttctgattaaatccatttatacctccatgaatcgtattcggtccggaatttactgcaagtttataggtctttccattcaactgaaactctccatttgcaattctgtttgcaacacgtccgatgatacatcctaaaaatttatcatctttatgacaatcttccacatcttgatatccaagaacgacatctccataatttccatctctgtcttttgtgaacacagataaaatatgacaaccaaggttactcgtgatcacttttatctcatcattttgtaattcaaataagcagactccattttgtcttttttcgatcatttttactttcatcattttacaacactttcttttaaattttatctgatatctttattgatccattttcattatttgccttggccatagtaagcatttgccccatgttttctgaagaaatgtttatcctgcagatattgtggtgctggctttgcttctggatttaaatgctcgcaacggtatgccatctttgcgacttcttctaagacaacggcattatgaactgcctcggctgcatcagctccccatgtaaatggtccatgatttgtacaaagcactcctggaacataaactggattcttatctttaaatgtctcaatgatcaccaatcctgtattcttctcataggcttcttcaatttcttcttttgtgaggcttcttgcacatggaatttctccatagaagtaatctgcatgtgttgttccatagcatggaatacttctccccgcctgtgcccatgatgttgcccatggggaatgtgtatgtacaattcctcctaaatctttgaatgctttatataattcaatatgcgttggtgtatcagaagatggatttaaatctccttccactctgtttccatcaagatccatgacaaccatatcttctggagaaagtttatcataatccacaccacttggtttaataacaaataaaccactttctctatcaattccactgacatttccccatgtatatgtgatcagacctcttttaggaagttccatatttgcttcatagacttctttttttaattgttctaacatctttcgtctcctttttacatgacatcaattgcaactcgttcaagtgcaagacctttttgatattgtttgataaattcatcaaagccttccacatctttttcatctggagcgatcgttgtaccttcttcccctgcaaatactttgtcagaaagataggtatcaagcatctcatcttctgctttatccagcatataggctgcaaggatcgccattccccatgcaccaccttctccagctgttttcataactgatactggtgcattcacagctgctgccatgatcttttgtccaacaccttctgttttgaataatccaccatgtcccagcattttatcaactttgacatcttcttctttcatcaagatatcaagccccgtcttcaaagctccaagtgctgtgtatagatgaactctcataaagtttgcaagattaaaattactatctggttttcttacaaataatggccttccttcttcaaatcctgtgatatgttctcctgagaaatagttgtatgcaagtaatccaccacaatccttgtcaccttctaatgctttattgtaaagagttccataaagctgatccatatctacatcttccacaccaaagttctgtgcaaattctttaaataagttgacccatgcattcagatctgatgtacagttattacaatgtaccatacccacaagatcacctgatggcgttgtgacaagatcgatctcatcataaactttctttaattctttctctaaaacgatcattgcaaaaacacttgttcctgcagatacatttcctgtttttcttgtcacgctgtttgtcgcaaccattccagttcctgcatctccttctggaggacataaaggaattccagcttccagattaccagatggatctaataattttgctccttcttcgcttaagatacccgctttatctccagctattaaaacttttggtaagatattttctaatttccatccaaattttttatctttgatcaggttgtcaaatgtcttgatcatcgtctggttataatcttttgtctcgatatcgattgggaacattccagacgcttctccaacaccgagcaccttttcacctgttaatttccaatggacatatcctgccagtgttgtcagataatcaatatcttttacatgttcttcttcttttaaaattgcctgatacagatgtgcgatactccatctttgaggaatgtgataagaaaatgcctccgttaatttctcagaagcttcttctgtcattgtatttctccatgttcggaatggcactaacaattctccatctttatcaaatgccatatatccatgcatcatcgcactaaatccgatacttccaaccttagttagtgtaatatcatatttttctttcacgtcgtttaccaagttttggtaactgtcttgtagtccactccagatgtcttctaatgtataagtccatatattattctccagacgattttcccagtcatggcttccggatgcgatcggatgatgatctttgtcgatcagtacaactttgatccttgttgatccaaattcgattcccaatgctgtttttccatctacgatcatttgctttgtttccatggtactacctccattttctaacgataaactacttcattccatcttaattcattctttaatattctgatatctgtattctcatcaatgacaacactctcaattcccatagcctctgcccatgcaaccatctgatctacactaagatcataagaaaatgctgtatgatgtgctccaccagctaagatccatgcctctgctcctttataaagatctggttttggtgtccagaatgccgtcgctactggaagctctggcattggtttttctgtctttttacaatccactttattaatgatcagacggaaacgatgtccaagatcgatcaaagaagtggctattccttctccttcttttgctgtaaatacaagtcttgcaggatcttcacgatctcccatagataatggatttactttgattgaaacaggaccatccgcgatcgttgggcatacttccaacatatgagcttctaagataccctcttttcccggaacaaaattgtatgtataatcttccataaatgatgttcctttggcatctttctttcctgctgtcataactttcatcagtcgtaccattgctgctgtcttccagtcaccttctgcaccaaatccatatcctttttccattaatctctgaatcgcaagtcctggaagctgttttaatccaccaagatcgccaaagtgtgtaacaactgcctgataatcatggtcttttaagaatttttccagtccgatctcgattcctgcctgtacctctacatgtttcttaaattcgatcggatctctgccctctaataaaagattgtatttttcataatataactgtgtcagtgcatcaatatcacctttgctgactgcattgacataatctacaacttcattgactggatatgcatcgatctcccatccaaatttaatctgtgcttcgactttatcaccttctgtaaccgcaacatttctcatattatccgcaatccttaccacacggatatttttactttccaccattccgattgcacttctcatccaagatgcgatcttttctttcacttcttttgattcataatatccaacaacaacttctcttgggattcccattcttgttacgatatgtccaaattccctgtcaccatgtgctgactggttttcattcataaaatccatatcaatcgtgtcatatgggatttcttcattaaactgtgtgtgaagatgtaataatggtttcttaaatgcctgtaatcctgcgatccatgattttgctggggagaatgtgtgcatccatgtgataacaccggcacattcttcatctgcatttgcttcttcaaatgttcttctgatcgaagtactatcaattaatgtcggtttccatacaacttcaaatggtaaaatgccactttcattgaaattctgcacaatgatctgtgcatgttttgccacatggcttaaacattcatctccatataaatcctgtgatcctgttgcaaaccaaaatttgtaattttttttaagttccattttttgcctcccagttttatatctattcttgattcctatttttacatgagtttccgatcaccaatttcggttcgatcaaatactctgttttcatgtctttatctgatccaccttgtatcttttctagcaacaactgtcctgccatctcgccaagtttttcctgtggatgagcaatagtcgttaaagaaagtggatgctgatgtgcaagcattgaattatcatatcctgtgatcgacaagtcttctggaattgaaacaccgatctgatgcaatcctccaatgattgaaaatgcgatctggtcattgtaacagacaactgcatccatctttctttgatcctttatcatctgaacaaccgatgttactggtttcatctgacgatcttctgtatgaaaccagataaccatatctggatcatattgatatcctgcttcctgaagtgccatcacataacctttatgtcgttctcttccttgatgatcatctgctttaaaaactcctacgatatgttgatgtcccatatcgatcagatattttgtaagcagataacctcctttacaatcgtccataagaatgtggggtttgtctttcatctcctcatagactccgtgaataaaaatgtagggaatttcatatttatcaagattctcataaagttttggatgtctgcatacaatctcacttttacttggctcaatgatcaagccatcaatatcttttgtaagaatatcttcaagacatgctgtctctcctcgtctgctattttctgttgtcttaaaaataatgctgtatccatctttggaaaggacactgttgatcccctggatcaatctagggaatatataatcagaaatataggttgtaaccactgcaatattctttgattcctttttatgaagtgcccgttctgtacaaaacgttccctttccatgaactgcaatgatataaccttcttcttccagaattgacagcgccttacgtacggtatggcggctaagatcatattcctgtactagttgattctctgacggcatcttatctcccggttgatagacaccagataaaatatcattcttcagtgattcctttaatgtgtgatatttcatttctcctttgttctttcccatgcttgacatcctccttccttatggttcttattttaaaacttgtacggtcctctttacaagttgttgtttatggtcgatattaacaatattttcactttatttctatgcacttttaacaaaaactattttttctatcattctgcttttccttttctactatctcatgctatactgactatcaagaaggagtaacatacgattggaggatttcatgaaaattttgtgtgtaacaaaatgcccgactggaatggttcaaacctatgttgcggcagagaaactagaacaggcaggtaagaaacttggcattgacctttctgtggaaacacagggagctatgggaattcaaaatcagttttcccctgaacagatcgatgaagctgattatattgtgatcgctgctgatgttgcgatcgacgaagcttcccgcttcggtaataaaaagctttatgtcacatctttagaagatgccattgttcatcctgagcagattttagaatctcttacaaccaagtcatattcttatcaggatgcaactgtatcgaataagaagattcttggctagaaaaaagccatcacatttatgatcttaatggtcactaatgtggtggtttttttcaaatatatgtgatgatcagatcaaaatacaatttgtaaattacgtttatttatgttaaactagaacatacattcgaaaggagctgtttgatatggaaatctcatcaaaagatttatctttaaatgaaaaattgaagattttagctgatgcagcaaaatacgatgtcgcctgtacttccagtggttcttcccgccgtggaaagaaaggaatgctcgggaatacagaggctgctggaatctgtcatagtttttcttcggatgggcgctgtgtgtctttgcttaagatcttacttagcaatgaatgtatttatgattgtaagtattgtctaaaccgagtaagtaatgacagggttcgtacaacatttactccggacgagatctgtacacttgttgtggaattttatcgaagaaattatattgaagggttatttttaagctctggaatcgtaaagagtccgacttatacgatggaattgatgtatcaggcgatttatctgcttcgtacaaagtaccattttaatggatatatccatgtgaaagcgattcctggcacttcggatgaattgatcacgaatatgggatatcttgtcgatcgtatgagtgtgaatctggaacttcctacgattgacgggcttaagaagctggctcctcataagaatccgaagaaacttgttgctccaattcgtcagattcagaatggaatcgtggatcatcggttgatgatcggaaaagatgcctctctggaacgttctcaaagtaataagtatttgaagcatacgatctttcaagagaatccttatcagcggattcagactggttcttccccgttgacacttgcagatccttctcttaagaatactttacgtttgcaaaataatgggaaaccagcttcttttgttcctgccggtcaaagtacacagatgatcattggcgcaactggggagagtgatctgcagcttttatcgacaacgcaaaaattatatcagcaatatgacttgaaacgtgtgttttattctgcttatgttcctttgaatgaggattctaatctgccagctcttggaaccgcaccgccgcttcttcgggaacaccgtctgtatcaggcagactggctgctacggttttacggatttaaggcagatgaattactttctgtagaccggccgaattttaatacgatgcttgatccaaagtgcgactgggcacttcgtcatctgaacatttatccagttgagatcaaccgggcttcttatgatgtattacttcgtgttccaggaatcggcacaaaatctgcatttcgtattgtgaaggcacgcaaacatggaatgcttaattttgagcatttgaaaaagatgggagttgtattaaaacgtgcgaagtattttatcacctgcagcgggaagatgatgtatcggataccgatcgaggaagattttattaccaggcagctgatcggtgaggatggaaagcaaaactgggagatcgatcatccacagacctatcgacagctttctttatttgatgattttaattttcaatcggaagttactgtagaagattcttcgaaaactttgtttgggcagatgtaattttcgttatttttgtattctggaggctattatgactgtttttacctgtgaagataattttgatgcgatgatgacttgtgtttatgaggcctgggcatcaagacttgggcattccaatattaaattgaaaacagaaccgattggaaatctggaattattctgtgattatcggcatgtgaatgctgattctgagaaaacttccagtgtcgttcgttctatcaagaataagatttcttatcaggcttatattataatctatgaagctgcgatgtctgatgccgaggataaactggatacgatttatcgttttatcgttgctggattccattatggtgctcatgttgtggattttcttcaggaacctgtggttatgcggatgtttgaattgaaacgcaaggttgggaatgaagctcattttcatgtggaatttatccgatttgcgaatatgcctggggatgtgttggtaagtcatattgagccaaagagtaatgtattgactctggttgcaccacatttttctgatcgtctgccttctgaaaactggatgatcattgatgacaaacgcttcattgctgtcgttcatcctgcagatcaagattattatttaacaacactttcaaaagaagaaatggaccggctgtccattcagacagacgatccgtttattgatctatggaaagactttttcaatacgatcgggattaaagaacgagaaaatcatcagtgtcagaggaatctgatgccattgtggtatcggaaacatatgacagaatttcagtaattttcagttttataattgttcttcccctaaatatttcatgaacgcttcacacccttcgactacatctctgtatgtatcgtcaaaattccctgtataccatggatctgcgatgtctcttggatgtttggaatagtctaataacagatgaatctttccatctgggtcaccacctgtaatacgattcatatttcttagattccatgcatccataccgataatataatcgtattctttgtaatcttgttttgtcatctggatagcgcggtgttttaggactgggattccttcctgtcttagtttatttaccgttccataatgtggtggattaccgatttcttctctgctcgttgcagcagagtcgatgtaaaatttgtcttttagtccttgattgtttaccatgtgttggaaaacaaattgggccattgtgcttcggcagatattgccgtggcagatgaataacacttttatcttgctcattttatctccttatatcttctcaaagccttgtaaatactggctttccagcattcatacatgtctctttgaaatcatattctacctccaaggggacgcaacatgatattgttagtatatcacgttgtctccacctcgaacatctcctttttttattttttcatcttttgaaatcttatagctttgctatacatgatattaagttgttattcaatatttggatttccaacggattagcagtttgttgttaaatttcttacatctttccaccataaacagggaaaattccactgtcaccatagctcttaatttttttaaaattctttaacagttccatgtcttcagcactaatttgaaaatctaattgggcattactcttcatatgttcaggattacctgtttttggcaaagaaattgcaccaagctgaagcgtatatctaatgcagagctgtggaattttcactcaattattcaatacaatacttctatcaaacatttcattcacctattgtaatttcccatattcttcatcacttaccggttcaagccattcattagaaccattttcgctcggaacctctattgccagatgagaaaaccattcatccggtgcagcaccatgccagtgtttaacacctgtaggaatattaatgcagtcacctggcttcatttctatagcttcgttgccttcctcctgataatatcctcttccggcaacgcataccagaatctgtcccccgccacttttcgcatgatgaatatgccagttatttctgcatccaggttcgaatgtcacattgaaaattccaacctgagaagtggagatcggtgcaagaaaacttctgccagaaaaatactgtgcaaacccatcatttggtgcaccgattggaaataccatctcttttgcatgcgcacgcattgcatcctctttgtatggtaaatctccttcgcctgcctcccacacttcctttgcaagattgaaaacagcccatgcttttggccaacctgcatagaatgcgacatgtgtgatcactgcagcaatctctttttgtgttacaccatgattttttgcattttgaagatgatattttaaagaagaatccgtaattccggaagccatcagagcaaccactgtgatgatacttcttgtctttacatcgatatcctggttattccagttttcgccgaaaagcacatcatcgttaaaatgtgcaaactctggtgcaaattcaccaagtgcatttcttcctgctgtctgtattatttttcccattttctgtatacctccataatactgttgtttataaagagtttatccaagcactgatttcctgttttgttccatgatttaacagtctgccctctgtaataactgcatctggtgcagatggctgcaattctttcacagtgttcccgaatccacttcctccggatgttgcaaaaagcacaatctttttaccactgaaatcgtaagcttctaaaaatgtattgatgattgtcggagccacataccaccagattgggaattaaaatgtagccagttcccctcatgcgttgattttactgggtttaactgtatacaaaactgtgtttactgttactatctttcattcttttccaaaatagctttgaagcataggccacattattttcatatatgacacaaagctcagctctacttgtgcttcattaaaccatccaaccataaagctatttatctcttcaaataatacttttgaaagtttctgaataataattgtgttatccacttcttcagtataatctttcgcatacattttacatatagaacgcactccaaaataattatatagcacacctaccgttgtttttaatgcttcaatatctcttggaaaatctgttctattcatcatattcactactaattgatgtcttgagtttaggtaattcctaactgtactattacctatttcaacatcaactgtaaatgaaaaatcttgagtttgtatactatctgctcctaacattatcatcaattcaacttgtgctgcatgatattctgtataaccagacaaagccatatatttccaagaatcttgctttgcatacatttccgtatctaaaatatgcgtaaattcatgaaacacaatataccttggtatttccgaacttttgcatatccttaatatatgttcatctgttttcgtattatagtaagcttgggcggctgaagcgaatcctgctgcatcgctttcctcaacattaatttcaaaaaaatctatcttatactgtggtaatttctcaatttccataaactcaatatattctttttcatattctttaattaaatttttaatttgtatttctgtcatattgttttatacctcatatcaaagttagcatttcacttttagtataccataaaacaatcccattctcattctatatattttatcctcaacgatgaaaagatgtgtctgcacacatctcttccatcttattattttcaatgttataagttcttaataaaattcaaatcctgtttccgtaatgccttctgtaacttttcgttctttctcttcagttccttattttctctgctcagagctgccaccttctggttcaacagttcaatctgtttttccatcgccatgttcagaatttctcttcttggatctatcattccggcctgttgctctactgcttggttcaatgtatcccggacggttggatttttataaaagaatcctctcgacaatccagttttcttcatcagctttggaacgctgatacgttctttatttgccagcatatcttgtattgcttgcaatgccagttcaattttctctttactttttctctgattttcctcaatcatcttgtcgtatttgctcatattcttcaccccatcttgccagactcatatatatgatgtcactcatcctctgtcttacttctctggtttcgtctgccattctttgattgctcattttccggtaatgctgtacattattcagtcttttatgccccaatagtctcgctatcgtccagtcatccagatgcatttctgtaagtttgacgccatagtagtgccggaacatgtgcgttccaaacccgaataattcgccatgatcatctctcaactgcttttcctgtatcatggacatgacttttgtttttatagccatatactgcatcgggcggtcaggttctttttcattaacaaatatgtattctgtatcaccgaacttttcctgtgtatattcaatagaactctgtaacagttttgcaagttctttactaatcggttttttatatcttttagttttaacttgatatatttcaatcatatcttggccattttctctcgtcagacaatctggtctcagtgtaagggtatctgatatcctagttccaagcatctgatgtatcagaagacatcttgcaatctgtacatccatctgtgtaatttccgcatttagtcgtttcatttcatcatcagaatacactctaaattctgcatttacttccggtggaatatccgtattaataaataaatgctccaatctttcatagctgtaaatttttccgattgtctctaactgtcgtcttaatgaaattacataagaactattcgcactatgggaagtatcttttgttgacagatatatcaaaaattcttccaacacttctctgtctatttcgctgcagctttttattttggaatactctttttgaagatattctgagaatatcctcattattgtcagttctccctgtacagttcctattgcttcatactgtaaattcatataaacagctttcttacattcttcccggatatctggctgatatatttttctgaaatccagtgtttttacattataaattggattggatctgattttaatatccagattttttagttcccagacatctttttctatctcatcccgtaaatcttctggctctaaaaatttcagtacgtttctgaaatataatatcgtcactgcttcgccatagcttactgtaccatacacactcttcttttcttttacaatagttattccctgttctaacatccagccttttaaaagtgatatccatttttctggatttctatctccaaggcttttgattctccgatttattctgctgttcaaaaactttgcaatatgattataagctgttcgatcctgaatcaatgctctaaacgttccgtttttgcagcgatacataatataacctcgaaactcttcctttaattcttgcgttggaagcaacgttaaatcaaattttccattatccttacgtgtccctgtttcttgtaaattggggaaatcgctgaagtatataatatcattttccatctttttcctctttctttagccatgatgctaaactacttccttgcatttcaaagaactcatcatttgcttttgcaatcctttgtggcatataatcaatatactgtcttgtcatctcttcataagtatgtccaagataatccctgatactttgcagtgatacatgactgtcataaaacatagttgctactgtatgtcgataatcgtgtgattgaaataaatattctccatttgcaatcttattttcccggcacgcttctatcatctgagttcggaatgtgccatatagacaagcaccacctctgctgtttttaaaaatgaattcttcaggctgaatttcatgttttttcaagtatactttcataatctgataaagtgcctgtgggattggaatccttttataattcttcattttgacctgatacacctgaatccaataatcctcgccctgctgataataagcatttcctttcaatgtacacacttcactcgcccgtaatcctagacaccacagatgtaggaacatacatcgtaatcgctctggaaaaagatataattttttcaaaatttccatatatactgtttcctcaacgctacgatcatgatgtactactacttctttttgttggaaatattcaattcggaatggcattcttgtaatatactgtttaacttccatgaatttataaaaatgaccgataccgaaaattctttcattaaatccctttgcctgtattccccgttctcgcaagccgtctgcatacttttttgcttctgcgacagttgcatgaatcgccagtatcttttcttgttccagcagttcaataaaatttctaatacatacaaatcttcgtacaatcgtgctgactgcctgtccagtaattcccagttcatatttcatgtatgcctgtaaaatttctcgattctgtatttccttgacttccataaaagaaatgctaattaaggatttactttcgtctatccgatgttttccaagatgtaatcgttccagataccatacatttgcttcccattggatctgttcctgctgcataaacgcatctcttctgcattcacctaaaatacttcgttgactcgtttcgggaaaattctttaaaatagtttccacttgttccatttccagcaatccaatatccgtaatatttaactgaacacaagaatcataaagaagttttaaggattttaacctgacatttctataagccttagacattgaagtattggcaatgatacgactcaacgtataaaaaatttgtttctttaaaacttctgaacaattttgtgtaaaatcccacaccaataggtttgttttataagaagtttcaaaagtctcagctattttcttttccggataatacttcagaaaataaattttattttgatatttccattcatatatccgctttccatttagcgtctgcatctgttgatagatatgttgttgttttaccgtatcatatattttcaaatagaaagatacaatttgtgatcgtatctgtcctcttaaatattgttcatacgaatttcgcaaaggataaatccatttcttccagatgccagatttttctatctgccaagaactttttcaatttgttaattcttgaatcgctttttattccaagtgcatcaatttctgaatatagttcctgctttttcttctcaatatctacttcagattctgttatgtgttctgcctgttgcaataaatatataggtatttctcacacctccctactccagcagacgttccgccccataaatagcagtgtgttgtgcataaaactcattacttgcttctatcagttcatcatccagccagtccagatactttatagtcgtatccaaatgtttatgccccaatgcctgactgatcatttccagttcccatcctgcctgctttcgcatatttgcaaaatagtggcgtaacatgtggggtgtgattttaactccggttttcttttccattcggtccaacatatcatatacactgtccactcttaatggctttccaatgttctcacccatgatattcacaaacaggtaatcctgatgttgcagaattttccgatattttgccagataatccatgagaaattcaaacgtatcattacttatcttggcacttctgtattccgcatttttggctcttgcttcattttcattatcttcccggaagcatacccttatcatgtgattcctataatcaatatctttgacatattttactcccagtagttccccgattctgtatccggtttctgctaacataagcagcagaagctgatctcttcggttcgtacaggcttgtaaaattgtaataatctgattttcttttgctgttctcccacgatgttcctcttccttcagataggctttaaaagaatgattccgcagtaccttttttactcccacctgattaaccgctataatctggttatacgataaggttttgagacttccgtactgttcatattctgcctctataaataaatagaacctgaacacatcttttaagtatgcgttgcaggttccttcattcggacacttcttttctccagccgtttgctctgtatggtttccggctttaagccagtataaaaattccacaaagtgttctgtctgtttttcataatctaactgatagacttctgtgagttccatttctttctctgccatatatttcatataatagcagattgaaaatgctgtgcgtttcactgtatttggtgaacgtttacatttaatcttatgcattagatatttacttggcagttcttcaatactcattgtttccagatttctgatgaaaaaatatttttctgttccatcttttatcgtttccaccttgtatatcataagctgcctcctttcctctaacgctatacacagtatacccacttcatgccgaaatagctattcatcaataccaacaatcccaccgaaaacgcccttgaaataccaccaaacttttcgtgcaaaatctgcttttcctgtagcagaaccacgaacggctacaggtagtattccacgcctttccggtttcggataaagtgctggacatccttgatatcttttgccatcttgcagctcggaagcgcacacatcacttcctcatgatacctgccgccttctcctgcacgctcgtctaaaatggacacgacacaagtatctgtctcggtgcgaagagcccgtccgaatccctgtcttaattttttctgcatgtctggaacaatcactgcctgaatataatctttcaggctggcatattccttcttctgtgcttcgctgatgggatcaggaacagcaaagggcagtcttacaatgattaacgaggataccatatctccggggaaatctactccttcccagcaggagccggctgcaaaaaggacagcattgtccatctgtttaaatcttgtgatttcttccgatgaatgtctccacacctctatcatcgggaatggaatttcatcccttaacatctggtaaacgtttcccatcaaatgataagacgtgaacagcaccagcgtatgcccgtaagtcgaacagatcagtgaatggatatgacctgctatcatctctgcctcttcctgacttcctcttctgcattttttgaaattctttggcagatacaacagacagttcttctgatattcaaacggggagtctgccacatattcccggactcttcgtactacctgtagtcctgtcatcttccgaatatgggaaaatccctgtccggtttttaaagttccgcttgtaagaatcgctcccattcctctgctccataacatctggtccagatactgtggaatccgtctgctggatgcacacaatataatcctgtgatcatggtcttgcttcagatgcagtacatacttcttatcctgatggaaaaagcattccaacacacttctggtttcttccagcttatttctgatccacttcggaatcttcttttctaatttttctatgatcttattcatggtctgtatcccctcatataaatacattgcacactcttctgtcatgtggaattcttcttttatcccatatctggttctgtggttttctcctatgatgtccagcaccatccggatcgtcccggacagttttcttatctccgggccttggtactcattcccaagataaaagcagatttctcggatatcgtcataacagaggctcttcccaaacatctgctttgccgcatccggcagcttatgtgcttcatcgacaatcaatgctcggtagtcttttaataacgggcggtaatcctgcagcctgtgataaccatcagccagcagataattgtgattacagatctgaatgaacatttcatgatctctggaacgctccagatactgctgatacctgcatgagcctcttttcgggcagtctcccgaacagaacttcggtacactcaccatccttctgtcaaacccacttaagttggacacttcgtccatatcataatgttctttcaacgacagcagagcttctttctgcaacgcatttttgtttttttcttcgattgcaacgattcggtgctccaacctctcatcgcagacaaaatgctctttcccttttcgtatcacagctttaataggggcctgaatcgtcccgttctcctgaagaatccgggagagaaaagggatatattctgtaagaattgctttctggagtgcaatgctggaagtggatatcacgaccggacgctgctcataaggggaacatccttctgcaaggagggaatattttctcatcagaacacaggccaccagataggcatacgtcttgccgataccgacacccgcgtcacacagtgctatgtttcttcccagcaggttatccagcattttgtggcataacataatctgttcttcccttactgccattccatgttccgggaacagcactcggaaaatagtatcaatttctcgatgcgctctattgagatattctcttgtgtaatacataatttgttacctgatatgcgtgctgatatcacatcaatacggctgtaaaggatttctccctacagccgtatgtatctgatatcaacgacacattcttccttgatttcttatacttttgatttttggcgttgtatttgtcctcgactcccccattgccttacgggaacattacaggcggatgcttggcattgcaccgctcacggattttctaaaagtcttgctgattacaacccaaagtccatcctctgctcactggcagttcctatgtatcattatcccctcgtaagtgatcctcgcaaaagaccgccacggtcctgtttcagttaaagatgattcgctcgaaacgaaaacgccacaaaagaactctgcctctcactttctggtctaatttcttccatgcccttttcatctgtcctcgcgtcttcctgccacgcttctacttacgggaacgtacctgtaatgctggtatgaggttgtcaaagtacactggcaaaatttacctgcctattaaatagccgacgaaaaacgccataattattcaatttttgataaattttttaatttttttctcaaacggtttcttttggtataaatcgtctgttctgccattcccataatcttagcaacttctcttccagaatatccccatgtactgagtaagaggatttccagtgtctgatgctccgtttctttcaatagttcatagattcgcttatcacctatgtgatccagaagctcctttacatcccttgcaaacagctcgctgtccttttcttttatggaatccatatcctgcatcgtttcatccagatgttcccggtatctgcgctcttccagaaagtcttccctgtccatctggcgcagcttttggatcttctcttcttccattcccagttcacgcaatttcttttcttcctgttctttccaataattccactttcgttcttcacttgtcttgttataagccatttatctttcctccgatctgatttttgatatagaaatcaaatcggagcatggcggtgaccggataggtacgttataatgttcgaaaaatgtcgaagaaaaaaatgctgcaacctcttcgattacagcacttttttccatcttacgtgaatatttcttgttggttcataggagattccttctttttctcataatgaataaaagactcttgtcatccattatttattataatttttctactattacaatagcttttttaacaagttttcttgtcttggagtttaaaagaaagctaccagtttttttcctctgatagctttccattcattcttattctgttgggaacatcgctgcttccaacttattcatctctgtatccgaaagatcatactttcctgaattatctttttccactgatacgtttacagtaacagctttcccataactgttcttttcaagactcttctggacgctttctgttaatacagctgcaaagacttccggatcatttccatccaatccctgctttattttttcattgcttacctctgtagagctttgttgcaatgtctgaaatacattggatggttcaacttgtacacttactgtatagactccatcctcttctttcacatcctgtactttatattttgccagtttctttacttctgtcagtttttccgcataatcagcaattcctttatctgtaatgttatcggaatcatcaaattgctgttggatactctcattaaaatcctcttcgatttctttcttggcatctttttccgagatctctaacagattcgcatagtctttatattctccatgatagtatgcatcaagagaactttgaacgtaagatttggcatcgaagtctggttgttttgaacaagctgataacaatatacatactataattcctatacttatgcataaaacacaattcttcttttgcatattctctccttcgtattttattggtttgccaaaactaattgattatatggatttaataaattatcattaaaagctgaatttttccattctatacattccacatattttttcatttaattgcaaaattgcagtattttctccaattcttgttttgaaaatcctttaactaatatttcttcgcctttcatatcgcattttatcttcttaaaatattccaatgctttataaaaatccacatctcctaatggttctccctgaatgggtactaataatattctccatacttttacttcttgatcatcaacctttgctctaggtttactatgaaaaatcgtatctgtattttctgtaagtggaaatactccaaatatattattattaccagaataaaattttgcttctgctctatatgcatttttccaatttttatttaatcctcttaaaaacatatttttcttcctccatttcaaccagtaaaacttcacttttttgtaaattatcaaaaagtatcttctcaaatttttttccgtcatttacataatttcttccagatttataaaaagacacttctggtataaattccgttcttatacttaaatttataaattttgcaagctgatcaaaatcaactaaaatttgtggttctgggaaatcatgctccttattaaattcttcatattcttttataaaactcttgtgttctggcgtcttaatcttttcactcaatggggtatctttcaaaaatttcataactatatgatacaaaccatgtataaatattgccaccgtattacctaaagaccgaatgtttttatccattccataaatatgttcattaatccaattgcattttcccattgactcacataattcttgtaatccgcaattaattccatctacatctttttgatataaatcatagaaaaattttgctaatttcaaatcaaattgagtgcgttttttccccataaatgcacttaattctgcttgtgctttatttcctacttcattatcatgataagtcacagcataaagcatattataaaaaggtgccgaataaccgcaagtagcaggtccctccttaaacggcataattttttccaacaaactataatcattacatgaataggcgattactacttctataaaattaattgtctgtgctccaccactattcgaacggttttgataaatacaattaaaacgattttcctgataaattcctttcaacatataattcatatcgccagttacaatagctttatttactccttcaaataaaattctgttttcacgcaacaaattaaaatacatattccaaaaatacccgtctgcttgtcccaattcaatttttttcgtaaattcatttattccatttttaacatcattccaaagcttatctgcactagattcacccattatcttttcatatttttgttgaaaactttttgcaccttttatcataacgtacccctttcttctccccagtgagatgttatatcccactgggtatgtaagacactttctaattatttaatactttaaaattcaaacttccattctttttaatattatacaaatttcgttcataattattaccaatgagattagctttttctgttcctaccgcctcttcaagacgcttaccacctatccatttcttagacatctgttttgttccatctttcagggtacttaatttactagtattatatttagcttcacccacaatgtactcgtttgttcctttattctgatatacaccatccaatccttgatgtccagcatcattaagacccgtaactctatcttgactgattctttcgaacccaatagaatcataatactgatccatcttcatttcagcataattccctttttgctgatttgtatactgcacaccatcttttattccattttcaaattttgttatctcttgtttttgcatttcttgagcttttattgtatcccaatgtttattatatcttgcagcttcatcagcatccattagttccgaaaaactattatatgccttgttatcttccagcaactggttattttgtgataagtctttggttgccatttcagtaatatgcccaggtttagtcgcacttgaacttccctttaccaaatctttcactgcaccaattgcttttcctgcaccataagtaagcccacctaaaataccaccagagattgctcctgtcaatccacctgttatggtatctttcgcaatctgtttcaagctgtttcctgacaatccagaacttattgcaccataggaagcaccaccaattgcaccagctacagctcctgaaaccattgctgttcctaaaccgcccattgctggcaatgctgccagaactgctccagctgctaaaccgcctgttgcagcaaccacaacacctgaaaccaccattgccgtcacaccaatcgctacattcttccagtttactttacccaactgatctgtaatacgatttgttgtcgtacacatatgtcgtaccacttctgagcggatttctgccgttctttctgaaacataggatttgaaagatgtataagtttttccaattttctgtaccccattgcttacagaacgaataaactgacttcctctggatgtgattttttgatatgtactgctactggttacacgatttttcacagattgatatgtctgttttgcatgtttagctgcatttttggcagtttttgctgcacccttcactgcgttaacaatagtttttgctgctttcttagctgtatttactactgttttgactacctttttcgcagtattaacgattttcttgccgacactcttgactgctttcgctgcttttttagctgtactcttaatcctgctccacaatgaatgtcctgtcggatcactgtaattcaacggattattggttgtataatcgtagcggtttctggttaatggattttctgtcgttcccaggtcactatcttcagttgtaaaggttccgttctctgcgttatagtatcttgcccgcagatactgaagtcctgtttttacatttgtggactctccattgtaaccgtaataattgactccatctgctgttcctgatgtaaggtttccatacgaatcgtactgataactgttcgtcaggttagcattttctgtcaggattccggttacgctgtttcttccgtcatataaataataactgctttcttccgatttatcaacgcttacccgttctccgattccactttctccataagtataagcctgacggactttctcgtctgctccatactctgcaaggacttctgtattttcacgattgatatcgttgatatactctgtcaatgtgtaacctttggcatttgaaccgccttttaccagagatgcaagctgttctttcgggctgtttccatcttcggtacgctggttctccggaatcaggacttcatcgccatagcaatcttcccatttataagtgttatccagttcgaatacccggttgttatctccatcgtacatggctgccatcaggactgttccaccctgttttactactgccagacgattttctgctgtatattcataagtgaccggatctgcactgtttgtcttatcacattcctggatcagattgccatctttatcatagctgtaggttgttcccggatcgccccagatctttgcattggtccgcttgatgagctggttggaatcattgtacttatagttatattttgctttgctgacaccatcttcgatcttctcgtaagaggtccggtttccaatcttgtcataagtataattatgaactgtctttttaccgccctctgctttttctgtacagcgtgtcagttcccagttgtcatcgtattcataggtacgtgtcgtctggatctctttttcctgatgctcacagtctgctttgtctgtctctttctgtgtatcgccccagttgtaccagtcttcccagcttggcgtctttcttgttccagcttccagttccgtagctgtttctccaactacatatccctgatcattgtacttgtactcataagtactgattactttgccgcaggaaccacaggtattcacaatctttgtgatatgatcttctgcatcgtaagatacttccgtctttgttccattacttctagtaacttctgtcacacgattcagtgcatcatacttgtatgttgtcacctttccgttacggtctgttaattttacgaggttatcatttaagtcgtattcatagctgacctttgtaccatccggatacacgattgcctgcagattatctgcgtcatcataaacgtagctgacatcctttttcgaaccgcttgtcactttggtgattcttccgagtgcatcgtattcgtaactgctcttgcctgtctgatccttcatggatacccgttccccggcactgttatatgcgtaggtcacgtccttttcggatttctcgccttttgcgtcctgatatgatttctccaacaggtcattcagtttgtcgtaatcatacgtggttttcttgccgcttgcctgtgtatatccggtcagtctgcctttttcatcatagtcgaatttctctgttcttcctgccggatctttgatggatgtcaggttgccttccagatcataagtataattcgttgtcttatttgctgcattggtgaaggtcaccaggttatccatgttgtcgtaaccataagttgttataccgccaagggcatcagttactttggtcaggttgtcattcttgtcatattccagatggctctttaatccggtcttatctgtaacaacctgaatattaccatgtgcatcgtaatcaaatcccgttgtaaatccacgcttgtctgtaatagaagttaccctgctgtccttatcataggtataggattccttctgccccagtgcatcggtctcttctgttacacgattgtctttatcgtagactgtctttgcaacatagcccatcgggtctgttacagatgtcacattataattcttgtcatatccatagctggtctttcttccacccggtttggtgatctcagtaatatttcctgccgggtcgtaagtataagcagttatcttaccaagcggatcagctgcagaagtcatctggcctgccaggttataactgtaggtattgctccgtccaagtggatctgtctccttcaccagattgccatacttatcataagaaaagctggttgttccatccagtgcattggtagaagacttcatgttatggagcttatcgtaagtataagtggtggtactctttaagctgtcgctttcttttaccacgttgtccactttatcataagagaaatttttagtataacccagtggactggtcatactcttcagacgtccggctttatcataactgtaggtatactctccgccattcgcctgtgtcatctttgtgacattgtcattcaggtcaacactgtactgtgtctcatttccctttgcatccgttacagaaatgacattgccatgcttgtcgtaatcatatttggtaactgctccctttggagagatctgttccgtcagattacttaagctgtcatatttgtattccgtaataagtcccatcggatcttttgatttggtaagatttccaatggcatcataacggtattcatttgtttcttttaacggagaagtctcaccgatcttgcggtccagttcatcatactggtaggttgtcgtatttccatttccgtctgtctgggatacgagattgtcatttttatcgtaagcatacttggtaaccgtaccgttttcatcgacagattccgtcacattatcatttccgtcatacttaaaggtgctggatgctcccagtggatttgtctgagaaataacccggtctttcttatcgtaagcgtatttatatgtggcttcctcttcttctgtcatggataactggttgccgactttatcgtaggtaaaggttgttttatgaccttccgcatccgttaccgctgtaatgcggtccataacatcatattcataagatgtggtacttccgtctgcttcagtaagtttcaggagtctgccgtactgatcgtacttgtatgttgctgtcctgccaagttcatcggtctgtgtcagtacatttccggcaccatcataagtataatccatgctgtttccaccattgtcggaggaatggatcaggttgcctgctccgtcatactgataggtaattacgagtccctgtgcatccgtacattttacaagctgtccgatggcatcgtactccatcagcaccttgtcccctgtcggcagtattatggatgtgttatttccctctttatcatacacatagctgtacgcattgccgagagcatccgtcatctttgtgctgttgccctgtgaatcgtattcgtaagtggtctttcctttcagggcgtccaccgtctgttccagattgtcggtggaatcatatttcattgctgtaatgttgccctttgcatcgcttaccgatgtcatgtttccattaccatcgtaagtcatggtactggtatttccattttcatcggtagaggataccagatttccatttaagtcatacttcatggatacggtatatccaagggcatctttggatgaaatcagatttcctgccttgtcgtaagcataagtatctgttcttccctcttcatcggtagaagataccagatttcctgctttatcataagtatatgtggtagttccactttctgggttggtttcacttaagcggtttcctgtattatcgtaggtataagtccatgttcttccactgtcatctgattttgataccagattgtctgccgcatcataagtataagtggtaactgcacctaattcatctgtctctttagcgagtcttccgcagttatcatattccttggaatggctgcttccatctccataggtaatctttgtttcatttcctaatgcgtcatattcatatttgattatattaccaactgcatcttttgactgaagcacctgtcccagagaatcaaacttggatacggttgcatttccatttccgtcggtatattttttcagatttcctgctttgtcatattcatagagctttgttccaaaatctttattactctcttctatgacacgtcccatgctgtcatacttataagtaattgtatttccttttgcatcggttgcttggacctgctgataattcttatcataagcgtagctgatctgatttcctttcggatctgtaccactggtcatgttgtacatcttatcgtaagtataagtggtgatattccccagtgcatcagtacttgctgtaatattacccacaccatccagtgtataagcggtcacaccaccatcggctgctgtcttagaagtcagattgccattcgcatcgtaactgttcgaggttacatttccaagtggatctgtcatggtaactgcacgattcatcgcgtcatacgtgaatccccatgctgctccatttccatccacatatccggtcatgttcggtccgtcatacgaatacgttgttgtgacacctctgccgtctgtctgggataccatacgatgtttgtcatcgtaagtataggtaatggctgttccatccggttttgtagatgtaaccatatttccattaccgtcataactgtaagtaaccgttgctccgttatatccggttgcactggtcagcttattctgctcattataagtataggaggctgtctttccatcctctcttgtctccgttgctacattaccaaatgcatcataagtgtaagtttttgttccggctgctgtcgtttcggaagcaagctgattttctgcattataagtcttttcacaggttgttccatccggatattcaatggatgttgtgcggtactgatcatcataatgataaacggtcttatttccttcgttatccgttgttgtagtagaattctttccgtacttgaaagtcgctgttcctttttctgcatcagtctgctctacgacccttccttctttatcgtaagtattctttacaaccgtattgccattctcatctttccagcttgtcatacggctgtcatcatcatactgatattcttttgttgttccattcgggtctgttacagataccagatttccctgctcatcatatttgtaagaaacttttccaccatctggaagagacagttccttgatatgcccgaatttatcctgttttaccccgaatgtttttccggatggtgtggtaatcttgctcagattataatcatcgtcataatccaatactgtcttaaatccattcacatccgttacataacgtaagattccgtatttatcaaatgaccagacgctctgatccgcatctgtcagttcccatccgatgtagtcatggtctgtatctttatagctgactgcttttaaatcatatacataaccatccggagcagtgtagcttccatcttcattcttatcaaagatcagataacttccgtcccctctcatatacagaagacttccgtcctccatttgagaaagtgactggtcatagttaaagctccatccacgtccgaacatggaatgctggtctgttcctttggaattgtagcttcttgtaatggagaattctccattcagttcattcatcgtcgcatcggactgatccatgtagaagttaccagtatttaagttgactggttcaaatccaaattcacagtgcaggcctcttcccatcaatgctccgtcaatccgcatcttatcctgatcggtaagcggtgcaggactatatggaacatttgtctgtgggttacggataaagatcgtgttatttgcgactaccagtgcgtccataacctgattgtctttcataatgttcttaagcggaacaccataatattttgcaatcttcgggaatgtatcaaactgcttcacttcatagatcacaaagctgtcactggtcacttcttttcctgtttccagctttccatcaatctctttcgatgcttttgctttgatcttataaagcttgtccttcgtcagccctgaatacagtgcactctgccagttggaatctttgctgtaatacttattcgcctccgggaactgcttattgtattcagtactgtctggataggaatacaatggttttgcatctgtttcgtgatgttcttcattttcctcatctggaagcagataatattctactgtagatttgctctttgcaattccgtctgcaaatacggcatcaaacttcagctttccatttgtattcttttctgtcatcgggcgaagcaggatcgttgtttcatccagtgacatatctcgcagatatggatcttcagccggtgaccactggatgctgagtttcggtccataaacggatgccctgttattcagtacctcacactgcatagaagctccaaggttatttgcctcggcaatggctaccagtgcaaatccgttattcgcatgagttccctgcacccagtcattgaccagatctttgacgtcataattgatatagctgttcctgctggtacttgcattctgtacatcctgaaacgtaagatttactggttttgttttccatgtgatggaggtgttccacgactgatctacacgataaagtccaaactgggatgcaccaccactgtatgcagttttctgactgactgcaaatgttgcactgtcaattttggaatctttcggaatctgactaaaatttgaatttactttgatataagtccggcagttctggtgtgcagtaccaaatcctgcaaggttcccagacttaataccatcatcaaatccgacatacggataattgttgtcaccaatctgactggtaggacttccctcttccacaccgatcatgttaaaggaactcttctgaatctctactggtgtcggatcgatcctgaccggatactgacgttcttctgccgaaagccaatccctatctggttttacggtcaggattgtttttccatcttcttcccgaagttccaatgtgatcaggaaactgatttccccggcagcatcttccattgatggcgtctccagaagatacttcgcatctttgattgtcttcccttccggatagatatagacctgattgtcttttacttctgcctgataccccggaatctgcagctcgtattcatagacttccctgtctgttggctgctgaagtacgatatcttccttaatgctggaatccagtactgtatactgaacatctgcgccctcgtaaacttcattataaaggatcgcattgtctttaataacggaatgtgtataatctccatctaccggaatgatcccgattctggtctttccattttcaatcgttacaccattctcttctgacatctgttccggaagaaggatagcataatcgtttgccttgttctgataaacttctgttttctcttccttttcttcagttgccactacactgctggcttcctgtgcttcttcggatgccggagtatctgcttcttctggttttacaagtgtattatcaaccagctcggtatctccatcctcattcttataagttccgacataacctccataaacggttgtatactgcttgtcccctgtcttataagtcttggaaatggcatcataatcaatcagttcaccttccggttcttctggaatcggatagtaatcctgtggttctttcaactccacttctttttcctgcggattttcttctgtttcttccgctggagttgtctgttcttcctgcgtctctgtatcttctgatggcgtcgtttcattttgtacgtccgcatcagactgctgactcttatcttgttctccagatgtggaatctgtaatccctgcttcctcttccgtcaaagcctctggtctggagaaatctgcattcttctgtacatcctcaatggcctcttttgcctgtacaaaaataggctctgttccctgtagtgccatcaggagtgcaagtactaaggctatagccgactttcgaaatctcttcatagtctctttctccctcttgtaatctttttctataattcctttacaaaataaccgctaccctccttttttctgactttggcactactataatctaaaaaatcacaaaattttcataaatggtaaaaatgccccttgaggtggcaaaaatagacgaaatcggtcgaaaaaaatagtaagacaccatcgccttactatttttcatctaatttcatatataataatattttcacttgaaaggatttctccgtatggcagatctccatctgaccatgatatttttctactacgagtttcacattttgtaatcctattccatgtccttctttcctgcttttcgttgtcagataaattccattccgcacttttggtgtatcttttatgctattctcaatctggatattcatgattccttttccataatacatctgaaacgataatctcctttcatctgaagctgctgtcccacgaatagcattatccataagatttcccactattatacttatatcaaataattcttcccctatatgattcggtatttctacagaaatctccggattttcaattactgatttcgaatcttccaaaatataattcagcagattattcatattacggttttctgtatataaatgatgacataaggctgttccggctatattctccatttgtttcagatacgatagaatctcttcatttcctcccgtttttgccattgcccctattgttgtaagatggtgcttgtaatcatgatgtatcttattcagcctgtcctgtgatttcatcatcatctccagttcttttgcatactggctcatctgaattttcatctcttcctgttttgctgtttcaatataacttttctgaacctcatcgtgcagatagaaaataaacacattgataaacagtaagaataatacaatcgtagaccgcacacctcttctgtctggcagcaatatcctgatacagactataatgctgatcaccgggacagaaagcatagcaagccaatgacggttctttatataataacttctctttacacctacttttctttcaataatgacttccagtaaaaagaatataaaatttcccattacaatagttcccggtcccatgtgatgatgcaccggatttcttgctaccgcataccgttgaaagaacacgattggaatcccatcacataaaattcccataatatataccataagtgtattccagacatgatgttgccagtctgcctgatatgccactgttataattaacagagctatcagctcaaagatcagatctccgtacatcgttccccactgcatgcttccccagcatgaaagcagatatgcacaaaaatatgcaaatagcttttgtgtatcctcattttttggatacaggatggtattgtaacggaacacagtataaatccagaataatttacttgtcagataagtgatcaaatggatattcataatcttttcttctccgtttgtaatagtctttccctgaccttcttgcgatttgctttactgatactgagacgtgtcttgtctttcataaccacgttgtcatattcgtaatgctccacgtgttccatattgatgagataggacttgtgaatcagtaagaaatattcttctgttacatccgctacatcctttaattttcctcgatattcatattctttttccgatgtcacgatatgtactctttttcccagactataaaaatacaggatcttgtcataagaaatcttgtggattccttttgtatccgtatattcaaatattttcttccgttcttttaacagttcccgtaattcacctatcacccggaaaagttcttcctctcggattggctttacaagaaaatcaaatggatgaatacggaataatttcatagcatattcctgatatgttgaaatataggtaatccgcagttcttttccataatttttctttcgtatctccgttccgatatcaattccattctcatgttccagacaaatatcaaggaataacatatcgtaggattcttcttccagcctgttaagaagctgctccgcagaatagtatatttctatagatatctgacagtcattcgctttcccataatggagcagcttctgttctaaccaattacataggatgatgtcatcatcacagattgcaagttctagcatattttcttaccctcagtctttcgtaacacgacaaatggggaaaagaatccccttcaattcttttcccgaatggacatcactaattttgtgtcatttttccgatgcaacagcaccacttcctttgctgtcttattttgtcctctatataataaacacttgaacaagaaaaaactgtcgccattttataatttatttatattttttatgttttatttatattttatccaaatattacagcgataactaataatgtcaccccctgcattattctttttatttttagcgtcatttgataaaacatcaacgtttttgatggcaaaaagggaacctgcaaaaccagattccctttaaaatacatgctcttctctaaaaggatgataaatccaccatcctctgcttatttttaaaaactttttccttttttacaatacttataaatattaaatggtttttcttttttttcaaataaaatccctgttgttttaataatttttataagttcatccgactccatatctgtcgttttaaatataaatattttcttttcatttgttatgaaaaaaaagaagtttttatataagaacattctatcaatatttttaaattcataaatttgatcttcatctattttaattgcgttttcatcgatatccaccgtttcatatcctgatctaccccagacaaattcatgaacatttttttcaaaatttttaccaatcatttgataccaaataatccaagccacacaagccacacaagttccaatccctattccaaacatcaaataactttccgacagataacaattaatcgacagtaaaaattctacaggtgtaaaaatatagataatcattctacttttctgtcttgttttaaataattgattaggaattataaacccaagcgaaagcattctttctaattcttccctatcctcatctgacacaattgatttaatatgcattcttcttaatcccccttttgccagaggtcctctttataaaatcgaacctctggccattgtctcttttattcttttacaatttacagcgcttgaatcaacaaaccaaaaacagtacctgctccagctgaaaataaagcaataattgacggaattgcatttacaactaatgcacccgcaagaactaatattacggctcctgccagtatattactatgctcttttgtgaattctacaacattaaattcaagaccactattagaatttaatgtcattgtaaaaatcaaagcaaccgatattgtccactctttttcctcttctggcagcaaatctgatgtactaaatacaatggaaaactctacactattggcaaaaacattatttatttcaaaagcaatattaccagatttaaccgataaagcaattttttctatcgtatttccaaagttatctgctccctctatacctgtatctgataaatttgatgaaatctccataatttgatttttgcaagtttgtgtcaattctccatcatttcctatatccacttttatattataaattttaccagttgaactttcaagcgatgtggatattttagtagaaatatcaattgctccttgaggactcatcattgttcccagtgaaatttccttatcatactccacacccacatccataattttattcagataaccaagcggctccattacattatagacatattgatttcgtgctatttttacctttgcccgaagattttcttgcgctatttcctcatctgtttttgtcgatacggcatcgaactttttaaatccagtatctctccctgaatatgcatctttatccagtgggaacgaaggtgatgaagaaaatgagttcaactcacaaaattgatcaaatgcccagttcttcggcatcgaatatcccaaattacagctaaatccagttgacatatctgccacaaatgatttacttgccaatcctgcttcataaactttagtacatacatatcttggtgcataaatgccgactttataatttttatcatttgtcgaactgaaaaagatcatgtgaatctgttcaaaataaggtataataaatgtatcaatctgatatgaataacaatcaaaatccactgcaaagtatatagtcgttccacttggtataccgattctctcggctgctaaaattgctgtctgtgcatcaacacttccctgggacggatccttaaaatagtttaattcatatcctccatcctgatatatcgggaataccgataatcctgcattttcaatgtttttcacttctgttgatgtcaaatatttcggtgtatgttcttttccaacagaacctgtcagataacgtcctacatgagtataccctgcattttttatatctaatgcctgttgtttatttaatactgttgcacagtcacacgcttttgctgccctgtttgtatcgcctttactcgtaagcaatgatttcatagtagaaacatttacttttccttttgttacaagtccaattcctgtcagaccataaaactcctgaaattctgacacctttgactctgtagtcgaatcaaacacgccatcgaatcttcccggattatatccgttaaaatatagtccgtattgagcaatcttattaaatggaacatatttcgtcgagttctgtccgttctgtaatgtacccggaaacgcatttgttgttgcatcgccaaaattaactgaattcaaatctgtaattaattcagttgtaactcattcagccgcctgcaatgcaccaactaaagacaaaattgtctgtcttgaggcaattccatcacaaggtccaacaccaataacatctgaccagtcactatttaattgctgttgaataagaacaatattggaatccccaccagaaacctttgtaaaccagtttagggataacaatccagaccaaactttccaatcaattttgcccgtaacttccagtcctgcattttcctgcatctttttaactgcatttactcctgatgtataataaattccagtaattcctccagcagcatatcctttgcaaaacagagcacactgaatcaagcatacattaacctgcggagtatcattcggatccatttttgtaataatggctaacttcttcatggtattaatagtaagtggtccaaccgttcctgtaatcgttgagattccattctgaatctgaaatgcacgaatgattccctgcatcacggctgttccggtctttccatcttcatccagttttacccaatccttatgtccaccaaacatcgcatttaaatatttttgtgctgcttttacattctgatcactcatattcactacctcctaattcaagtcaattataaagatttctaactctttatatgtctatcactaaaagttacaataacaatttatcaatcaactgtgcctattttgtgactattttccaaagaattcattaactcccttataaaatccttaacaaattatgaaagaaaccatcaatttatcaccccatatcccattatagaactgtaatctactgcataatttctctgccgtacctgatcactggaatttccctcaatcgtgtaaactcttccaccttcacacttttctactattcctacatgatccgatgttccatcatgatcccagtcaaaaaagatgatcattccagctgtcggagttgttccgccactctgccacttattctttccctgaaaccaggacactccatcactgcacaatgagaatttaggaacattcccacttgcaatcagaccgctctgatccgcacaccagcttacaaaacaggcacaccattctacccgactgtcaaatccgtaccagctccagaacttctgaccgccactgtttccaagctgccccattgcaaccgacacaatctgctgattaccaaacaaaccagcaaacaggctgccaccggaataataccgcatcacatggggaacgtattggggatctccgtaactgctccatccatgcgaagctgcctgttcctgtgaaaactgcaatgcattggcttctgtataaccgcctctttgcaatgcccatcctatgtagccatttccatagttatatccctgccatgcaagtttcagcttgtccagatcctgtggactgctgcatcctgcctgtctgatacagtctgcaaaggtctgtactccaacctctatcgaataatccggatcagtaatagaaccaggagtgtgtgggaatcttgtattatatggactttccgaacactgcatcgggtctgttcccctgcctccagattcctgcatcatgatggcctgtatcgcagacacatattccggaatgccgtattgggatgcatactgctgtatcacagaagtatacgcaagcacttcttcacttagggattcggagctttccgaattactgctgaaagctgctcctgcaatgattcccacaatcagaataaataccagaagaaatgcactacctccggcagcaatccattttcccattttttcaagagctactacccctttttgaatcgctgctgtaattccctgtacggataactttgaaccctttccagttacctgaaggactgcttttccactttctgccgatgcctgtgctgactttcttgccatctgggctgctcttgctttctgcatcgcctgaagacttttttccatctgctgtttctgcatggatgcctgtgtctttattttttcttgagacagaccggatacttttaccactctcggtgctgctttcacctgccgtttaccattctccttggcaagtgctgcctgctccggtttcaacttgattaatttctttccgctttctgccccctgctccattgcttcttcggcagctttcgcttcttcctgtctgctttttctttcctttatcttcctgtaggtcactccagcaagtttttttccaccttgatatgtggttttccctatactttttcctgccacactcgccgctctgtactgtacggattctattttttcagttccatactgtgttggggattctgactgcccactgcttttttcatgtagttcccttggcttttcttttgcttccagaaccgctgagcgaaccagttctttcggaagtcgggcagccggatttcgaatcttcggattcttatcccttacccgttccttgatatctttcatccggtcaccctctttccgtatctcttatctcatcgggcaacatcccgatgtttctttttttcctgctgtttctgcaactgctccacctgtctgattgcctcatttaccagtggatgttcgttgtaatatggcacaagttccaagtctcccctgtcttttgatgacaacggtaatggatattccatgtctgaataaattgattctggatcatgaatagaaaactcaatagccggacacatattggcagatgttctacaatatttctggtactttttatatgcctcttccagcgttctgcattttgtatattctcctaaatcatggaactcaccgcactctgcagcataaaaagttatcgttacttcttcttttttcttcattatgattctcccggttttgttgtcattagtttataaaggtctgtattctttgggaacgtattctcaaatggtacgatattcccagagcaacggattaggccactgccaaccgatacatttgtaatataggacagttggttttcggaaatattcaaaagagctgccaattcttccctgtctgtacttgcctgattcaaaagaatcaaaaactcactgtttgccaacatcagtcttgcagtgtccgatttcagaagttcctcaacattttgggttaaacctgtcacgaatccattgtattttctgattctcttgtacagtcggtagaagaaatttgcactgtattcatagcggaataacagatagaactcatcggcaaatatccatgtcgtttttccttctttccagttctgaattaccctgttgaaaatactgtctaaggtaaccagcattcccagtggcataagctgttcccccagttcccggatatcataatccatgatcctgttcttcttattcacattggtcggctgtgcaaaggtgttcaggcttccattgataaaaagttcggatgacagtgcaagtccccttgcctcttcttccggctgtaacatcaactgtcggtacatatctttcaatgtcggaacttctccggtataaccacttcggatataatcccggtacacatctgcagcacagcggtccagaatcgacttttcttttgccgacagatttcctgctccaaccaactgctcgaacacagacaggataaactccgatttttcaatcagtggattcttttcattgccgtaggctgcgtccatatccattgcattcagatgattgtctgatgtcgcagatacttttacaacctgtccgcccagagcctctactaattttgtaaattcggactccggatcaagaatcaggatatcgtcatcggtactcaatgccagatgcacaatctcttcttttgccgaaaagctctttcctgatccactgacgcccaaccggaaactgtttccattcatcagtttcttccggtcggctaccagaaggttcttgctgactgcattctgcccataatagatacctcccggctgcaggatttcctgtgtatggaacgggattaaaacagccgttgattccgttgtcaatgtacgcagggcattgatctttcgcagtccgtaaggaagcactgtattgagtccgtccacttgctgccactttaatgttgccatctgacacagatgctttcttgcgattgacagaatcagttccgtatcggaatccagttgctttttgctgtctgccagatgtaccattgtcaaaatcccgaacatcatacgctggtctctggttgtcagatcatcgagcatttccttggtttcttttctctgaagttccatatcgtatggtacgattgccgagaagttattattagcgttctgccttctctgccagttggtcacgttagtttccacaccaagcagtcggttctggatttcccttaccgcttcatccgtagggactggcaggatgtcaatcgacaacatcagattccggctaaagtcacacaattctgaaatcatgtcatctttgacataacttgcataatcctgcatatacaggactcttccgtatctgtcaccgattttaaaatggtcacgttcaaattccatagaatccggacacatccagtccttgaaacttgttcccttcttggcaaattgtttcagatcaaacggaaatgcctgtgggacatctcccttgaagaaatccctgaaaatctggagccggctctctgcgtccagtccttctgctgtggacgataactttgccagatgtgttacgatgtctgttccgatacgtgcaaaataggttcttgcatcatcaatcgatcttttatgtacactgacggtcagataccgttcctgatagatgctgttgtttgttcctgtaatcttagacaggagcatttcgttgtattcttcccgatagtggtccagtccatcttccttcattggaagcagaatagacttttcgaattcttctttattgattctccgattattgatggtaatttgggcagaaatgccggaatccagtgaatttaagagttcagaataatccagaaacatttctgtcttattgtccttactcgcaatataatagttgatatctgtaaaacgatatgtttttgagaatttcgttccctgttgaaaaattccatccggccagattcgctggatgggaattgcctgttggacagatttcggaactttgaagcgttccttatccatccgaagtgcctgacttaaggttttaatcaaaggcatcactccttcccttgcgtttctttctctgttttgcttctgctttttgctcccgctcttttatgatttccgctccatccttttgattcttttctcccagcgagatggtctcctgcatgcaggagtagtagatatcttccgactgaaacaccagtttcttcggatacagcaattcggatttgatcactgcccataaaaactgttcggctgtcataccatgatatttgaaaaagccacaggcagcaaatggagcagcaccaagcacacacagccatccggttatttcctgtccggtaatatcacgcattccaaagtaaattccgattgctgtaagaatcgcaagaacagaacacatacattgtctcaggtccagtcccataaacatggattcttgatagtccctgatttctttgttcatctttacttccataaattatcgttcctctcccctgttttgtttcttcgttttctgtggtttttctttcggtacttctatcccggcaaatctacagtgttccgcaacgccttccggatcaaattccgcaagtcttgcaaggtcaaacgctaccttctgataggttgcatatcctgatcttcctgtttcattcaacacttttccaagtttatgttccttgataaaatgaagcatatccttggtaaaatctcctgttataaaagcctcatttggctctaagaactgatagggcagattaatggttacatctccaaaatcttcccagtctctcccttccttatggcagagtcctacatataaattcccattgttccgataagagctcactcgtatcgctactgtctcacgtccgaattcccagttatatcttaatgttttctttgtatccatattttttaacctccaagtcccatcatttctctgacaatacggtcagatgccttaattgctccaacaagtaccaataaattgaataccagttctcctacatagttccacacgattgtaactgcactcagctccgtatctcccactgccggaggacttgccgcataagcagaaaagataatacacgccagtgcaataattgccccttccagacacacgcctatataagaacggataaagttctttccaatagactgcgtgggttctcctgcaaacgaggaaatcggaatcggggcgattgccgtatacatatagattttgaacattctgccatacactgtcaggatcatcacaaatgacaatacggtgatcagcagactgccaagcagtgtgacaatccacaatggaatggattccagcattcccacactctcgatcttatctacaatctccgttggcagttccgtcacgcttcctgccatactggagccactcattacggttgtcacgattccttgcacaatggaaaacagtgcctgcataagttccattccatacgtgattgctccctgagcaagtgcaaaccggataaatgcttttagcacatgttccggctttttcagatctgtaaaactgccacacgttttaatgattccggctgcaaaaaacaacaccagtaatccataggcaatagctgtcagtgcatcattgatattggtcataatccgccagatgccgccgcctttaaaagttgccggattttcagtaagcagtgtccacagttctgccatcttttcactccatgtagacaacgcagagttcagattctgtacaatccagttatcgctcaaaaactttcacctccctgaacatacttttgaatgcaggagtaccttccggcactcctgctgtttcctgatatactttttcaaagaggcttacgccataatcagatccaggatttctttggcgaacgtaataattactcctccggccagtgtcagaaatccatttgccctctggcttggatcatggctttttaaagacagaccaacctgcacaacaccaaatccaagcaaaatcaaaccgattgcacgaatcagggaaaaaataaaagtagacaggttattgataacggacaacggatcaccggctgcgaatgcggtcgttgctccaaccgttacggtcagtaccagtgccatgtaaaggctcatccactttttctgttttctccccatcggcatcggggttgtcattttttcagttgtattcttttttgttctattcttttctcctgtgagaaatttcttcaatacacatcactccaatccatcaaaaaactgctattcaccaaggatgtcttcggtagacagcagttcgtagtcgtctaatctgttaatgtcaatctttaggtcgtcgtgagccagtggtgttttcgcataatcataaggcgatgcaccaccgtcctctgtgtatctgaaattcacatgcttttttaaatcatatttatcgtccatgatcggacgctccccacgaataaacaaaatcgctttgcggttatctaaaagccgtatttcatccggtgttaaaagttcccttccagtctgctgataattcaccgaatagctgccgctacgcccttttgtctgtccgtaggtattggtatccaatgtttcttttcccaataattccgagacatacttatgtccttctttttcatttccacccagatataaaaattcatcgcagttgccgatcagactctcatacgagtctttaaataaggctttcatctgtgcgatattctggatgatgatactgcaggaaatccctctggaacgcatggttgccagaatcttgtcaaaatcatccggcaaggctacgtttggccattcatccataatgcagtgtaccggaattggaagccttcctccgtacttccggtctgccacataatacagtgtctgaaacagattactgtaaatcatgccgaccagataattcatgctggtgtcggcatccggaatacagcaaaacagtgctacttttttctccccgatactgtataagtccagttcgtctgtacaggtcagatttgcaatctgtttcaggttaaaagctgccagacggacaccaaccgagatcaaaatagactttgcagtctttccggctgcctgcttataaatggcatactgcttgaccgcaatactctccgggtcccgcatttccagtctttcaaacaaaatgtccaatggggactggtaatcctcatcatcttctttgacctgagcgcttccaagcatttccatgatcatcggaaagttctgttcttccggtggagcctcatgcagcaaatacagcataagtgcctgtaaaagtgcagtctcggacttctcccagaacgggtctgaactctgcgctcccttcggtgttgtgttgcggatcaggttattgatcagcttcagtacatccttatcatcccagacatacgcaaacggattataacaccaggaagtctccggattgatcaaatcaaaaacccggacttcatatccattccgttccagaacacctccggttttacgcaaaagttctgccttgggatcagtaatcaccatcgaacagttgcactgcatgatgtttgggattgcatacgtccggctctttccagctcctgaacctccgactaccagcacatttaggtttcgtttgtgcttatagccgtccagtcccatacggaaatgctgtgttaaaagcagattttgcgtgtatcgtttttcgcagtaacgtctgcagatttcggacacgttgccccattttgcggaaccatgttccacacctcttctataatttcttttttgggattcataaataccaatgcctaagaaataggctgctgtgaatatcagaatacatttgaacgtatacggtgtatacgtgataaaaaacggctgttcgagtttttcgctcagcgtttctaagatttgaataaaattcttatccggtgcaatggcacaagcggtaatcgctgccgcccaccagacaaatggcagaaagacaagacacagaaccaagtcctgcttttttttacttatctctgcaagtcagattctcttttcttgcgtggcttttcttctggatgttcctgtccttctttcttatgaaaggaatccactcccggtatcagtgagagacttctgccgttgtcccaactgatgccgagctgacctgcatcatccacatactgcacagttccttccagtccctgcggcatacccgcttctccgtccatcgaatccagacagattcttgttcctgccggatattgttctctaagtcgtgccactttttctcttgaataaatgaccaatcaaccactcctttctctaccagaacatgtgtctggtggtattcggttttgcaacctgaataatgattttatctattccatcactatatcttccggctgcaagatatttacttctaagcctgttcagtgccttacggatctgcctttgttccccggctgtaatctgcagccgtttctgggcgaggtcgtattcacttacttttttcagaagagctttcgtttcttccaaacattcatcctgctcactctgtgcctgcagctcatcattcagtgccaccacgaacatatttttcataatgttatccatcttcaaatagtattttgtcatctggctgacctcctttttttattacaccaaccatatcacaagacctccgtaatagctactccaaccgtccaactttttcacttttatcgttccggctggctctttgcttttttctcttttccggatacttgttcagatggtttttcatccttggtttccggtatttttacagggtctccgattgcgaactcatcggttatatactcctgttcctttgcaccaaaattgcgttcgatatggtttcgtatactgtaggaagcctgacggacatcatttaaaaagtctctcagttcctgcggatctttctttccacattcatttctctgtgcaatatactccagattgaatccggtaacatccacaccataacgttttgcaatcacataggccgcacaatatgcctgtgcgctgactttctgtcggctgtaggttccggtatgctggtccagtgctgcacatgccagttctctgttcagtgcatggaatgtcgttacttcactcattccgttgcggatataaatggtacggtatctcggattgtactgggcctgcactttgtctggcagatcatcctcaatctgtacacgcaccgactggtcttttaagacaactcctaccagttctgtcagacttcgctgtgggcgttcttctaatggctttcctgacatctgactgatgtcaaatccttttccgatcgtatatcctctccgcatttctccgtctttttcgtattcagtggaaatcatataagtaatgccatgctcccctgcttttactgaacggtgttcttctctccagcgttcataagaccttaccaccttaaaatccggatgctgtccgtagatcaaaagcagattcggagttctctgtgtattacactctgccataaaatccagaaagcctttcagtttttctccatcctgaaaaactccctgtgcctgtgaatctacttcagcccatacctcttctctttcctgctgcttcttggctgcatattcttccttggtcaatttctgttcaggaatctgctgttcttccgttccacctgaaatcatgtctgttaaatccatatacattacctgcctttcgttttcatattcttacgtttcttcctgctctctctggcatttttccgtctgtccggcctcttacgtttctcttcctgttccttacggatatctccgagttctttccgcacagatggtttttcattcttttcttcccagctagtttcccgaccggaagaaatatttttgttgcgcgagaaaggttcggacggattctttgctttcccctcctgcgcatgtgtaaaatttccttccgggaaagcctcatccccgatctggaacatttcttccgcatcatccagttcaaattctatcttgccttccggcaggacaacagtctctgtccgtacattctccccggtttctttttccatctggttctctgccttttccggtgcattctctttttccactgcttctgtaaccatagagcctgattctgcttttacaaaatccagattcatccggtctaatacccggttcatctttgctgcatcatctgcaaataccatgacctctgtctgatccggattcaccttatctttgatgacaacatataagatacctctcgctttggcttctttcgcaaattcttttaagcggtcacccggaacggtaaaaaatttcatcgggcgctgttcctttaacattctggtaagccttgttttccctcttgtctttttctgatctttcagggcggccgcaataaagattgccacatgctttgccacatttccggtaatcttcaaagagtattccattccttccagactgtaccgcaccacctgatctgccggttctgctccgtaattcatacttatctcacctcctgactctctttttctttgtgttccacacgtttctcattctggttttgttcttctgcctttcgaagtctttcttcgatttccaatgaatgcttttcaatccggacggtcatacggacttcttttccgagattttttaattcctcattgatttcagacagccgtgcttttccactgtcttcactgtcattccgatagagctttctgcgttccttcatcagttctgaaatctgcttttgtaacggctcatggtatgtggcaagctgttctctggtcgtaatgtcatgcttcattaaaaactcaatctgttcaatcctctgatccagtttccggatatcctctctgacagcgtatggactccttttcggtctttttggcagtacccccatttgatataaataggaataatacagtgcctgaatcccggtcagtttctttttgggatgaatctgtactgccttttgatagactcgtttcaccttgggctgtagtatctgcccacgtatttcctcttcagaataattttttccaagggaacgcagacgaatataccgctccattcccggagcttttaaagaaatgtatttcctgttcagtttccatgtataaccccgcttttccatctcttttaggaattgtgaccaggagtagctttcctgtaccgattccctgatatccaaacggatcgccgttctccatgtcggctttccttcctgttctgctttccactgtacataagggattgattttttctgattggattcaatgatagacagaccatattttctgcacagctcatcggagatcttccggatctccgtataataactctttgcattgctgtggtacttacgcccgtctgccatgctcacagagttccagacaatgtggttatgataatgtctggtattcagatgcgttgtgataacgacttcatactgtccctttaagagccggtctgccagttcctgtccgatgagatgtgccagttccggtgtcacctcaccttctgcaaaactctgtaccagatggtatccttccacaccgcccatcttatggaatctcttttttgttgccaccatatctgcatacgcattttcattggtacatccgatggtatcttcgaagaccgcctgttccgtctttgtccggttcatggcataatcaatggcagcctccaaagagtctgctttctgtgtggttttttctttgtctttcacatattcgatggaacggtccaggcggtggacggggataacacttgtataagccatcggtcattaccactcttcctttaccagatgccatgtctctttggtaagccgcagcatttcctgaatactctgctcgcttgccataccagaagcattggcaacatgtgcaagctgattggcattgttgcataagcctgcaatctttcggagcaattcgggatgatgctcacagggttttgcatgaacctgcgctcctaaaatcaacgaacgcataaactcttcccggctcagaccgcttctttcgacctgctcattcagttccctgacttcccttgcattaagccgtaccgggatcacatggtttcgttttcgcattgcatcaccgtcccttcttttttctcttcctctttcatcataccgccaagatcctcatcggattttttcgctgcaaccatgcaacaggtcactatcactcctataaatcctccgctcatcaatgcgattacaatcattactccatttcttaacatgacttgatccttcctttccatttccgtctgtgtccgggggattggggttctccccaaagtgcgtttggatatccaaacgctatgcttgcaaaacgagtaccgccagtttctgtagcaccggattgactcgattctgatttattttgattcttttatctgtaccagtccatcaagtgtcgtacaaatgatatggagtctgtctgccatactgatttcggtattcattgttcctgtcacttctttcccacatacgactaccatccggcatctccgtaaaaggatatgggacattcttccatatccctgcatatcttctgcatcagactcttccaagaatggtgagaatacaaatctcggacagattggtacatacccaagttcatagatttttctgcaatatttctgcacttttacccggctttcttctgctgaacagcacacataagccagcgcctgttccatacgctccatctccttcctgcatccagttggatgccactcattttctctataaaaaacaagatgtccaattggacatcccggctacttttcatcctctttctgctctgcttctaatgcaattttcactctgtcacttcccagtttgtagtaggcatctgttacctcaattcccactgcacgataacctgtcataaccgctgcaaggacagttgttcctgctccgacaaacgggtccaggatcagccctctcggttcacaaatctggataacatctttcataagctgcaacggtttctctgtcacatgaatccggttctgcggattgccatatcggaagacgcccggcagacaagataccggacggttgatcggcatcggtccgttactgccccacacaatatattcagcctgctggcggaaacggcctttctgtggacgggagtttcccttatcccacaccgctgttcctcgccagatccatcctgcccactgcaatgcatcggtaatcgatggatactgacgccagtcaatgaacagacagatcggagcacctttcttgcaggctttccgcacatcatagagccattcagccatccagtgcgtccaagatctctggtctttgttatccccatcgaaatccggaagtgcattggcagcactcatactgctgtatttctgatttgtagtacgatttctttcattctgttttgttccaccggatgcatacggcggatcggtaataactgcatcaaagattcccggctggaatgctttgaccagttttaatgtatctccatgtaatattttccagttttccccttcagtatattcctccgggtatgttccctctttcataagttcttccaaactcaggccatttgtcataggcatcatcctttcttttctcagcgttccggctgatttttcttctttgtctttttattttctttgggcggcggactcaactcagtttctacatattcgctgataatcaaaagtgctttgtaatagtccccactttccaatacccttttacgcatttcttttgcttctgctgtctgtttattctttttcaaaagagttgaggcatcgcccataatggaaaaaatattcccatcatgtccaaggagctgtaacttgggacgttgtttctcaggctttgtcggaatctgctctgttttcttttcatacattttcggctgttccatattaggatgccaaaaatgcacattcatcgttccaccatctaccttgatatccctctgttcaaatccttcaccccacccgtcactgtactgccctgtaatgtattcggtgaattcctgtagttcttcctgacttaaaaattcatttaattccagtttggtacagccgtacaggattccgtctttgttttctatcgtaacaactgcactttgtatcttttcctgaatggactcacttccgtcaaaatactgcatgagatcatcttccccatagcgttccagttcttctcggatgacttcttcataatcggcaagttctgttccatctaatggcattccatattcatcactctccgaccactcttcttcccattcggattcttctgaataaagatttccagtcagctccgtcaacagatgtacgtgcatcgttcctttttcttccattctctatcaccttctttccaatggtctgtccctgcatttatttgcctgctttttttctttcgcaaggtctgcataatcttccccttctttttccggcagattgcagataatctgatacgttccctcgtaatgttttttcatctgttctttcgcccatctcccggcaaagtcattatcggtgcatatttcaatttctttgatttccggatggttcttcagaaactcttccagtgcgtccggcggctttttaaaacgttcactctgtatcagtgcgttttctttcggagcagcgattcccccaagggaaagacgatatttatccctctttccttcttccagtgtcatgtgtgccaatgcatcaatacacgcttcatatacggcaactcgctttgtttctctttcaggtggaatgcaaaagctgtactttttttcactcccggtctgctccatcttgaatcccttcccgtttttttcatagattcctcgcaggaatgcatatcttgcttttctggattcatctttcccaacaaaaactgcgttatggtacgggacactttcataaaggatttcatgtgaaatacaatatgtgatcacttcatcgctgattcctctgtggtttaaataagccctgattcgtctgcaattacaatatctctccggcagtttaaatagtggtttttccttttcggcagactgtgtcggaataaaagacggactctcttcgcacagcagttttacagcatctgtaaatttcattccatccacttcaatcaggaaccgcagtgcagacactcccccgatatctctggatttccaatgccatttactcgacaattcattgattttaaaactgtcatggtccgtcaactgccattcatttctggttcttgtcttttgcagtctctgtgcctgatgtgttcgcaaatactcatacgcagtcatattttttgctgcctgaatctcttcttctgttacccaaggcattacagaatcgtatcctgaagagccagtaccttatctgtccgctcccaaggaaactcctttcttccaaaatgaccaaaaactgccgtctgccggaaaatcggacgattcaatcgaagggattccatgatctgaacgggtgtcactccaaacaccagtgggattgctgccgccagacaatcatctgcacacacttttcctgtaccaaaggtatctacctcaatcataaccggttctgctactccgattgcataagccagagacacctgacacttgcttgcaaactcagcagctactatatttttggcgatataccttgccatataagccgccgaacggtctactttcgaacagtcctttcccgaaaatgcaccgccgccatgcggaatcatactgccataagtatccaccatcagctttctccccgtcagtccggtatctgcatcaaaccctccacacacaaattttcctgacggattaatcagaatcttcgtatcctcatccggcggcagtaatctgagtgctgagcgaagcactttctctctaatctcggcatctaacttcttcaggctcttttctgcaccatgctggcaggaaacaacaacactttccagtctcactggttttccatcttcatattctacggttacctgtgcttttccatccgaaaagatatctttgatatatccgcttcttctgcaagccgaaagttcacgtgtgatccggtgtgccagaacagtcggcattggcataagctgcggagtatcatcacacgcatatccgaccataacaccctgatctccagctcccctgcttctatctcttaattttgcgccgatattatcccgaaattctttcgacacactcactgctttcgcaatatctggactctgctggtgtacaaacgtatccatttctatcccatctgtacaatatccacactcttctaaaacttttcggatcacatcaaacactggtggttcatatccgctggtgatttctcctgctacaaacacatttcctcttgtagcaaggacttcacacgccactctcgaagatggatcgtaacgcagacattcatctaagattgcatctgctatctgatcgcatactttgtctgggtgtccttctgttactgattctgctgtataaaaacgtctcatcattcttctccttatatacagacagggcagaagctgctttatgcacatctcctgccctgtcagattggtttatcctgtaattcttattttatttttcttctgtttcttttttgttgtctgtcatttttgacttctttctgcggtatacagtcactcctgtagctgttccagcagatgccagtgcaagcagaacaaacgcccatattttctggttatcacctgtttttggtgcatttgttttttctgttgttttctccggtgttctggcatctttcatttctactttctggacttccattgtatctttcaatgtaaatgtgacatcttccgcaatctcgtaaccatccggtgctgtgatctcacgcagagtaagttcttcattgactgggagtttttcaacggaatgtggttttccatctgtaatccactcttccagaacagttccgtctttgcggataatctgaagctttgccccttccagttcttttccggttgtaaggtctgtttttgaaatttccactttggaatattcatctttcatctcaacctttgtcacactgccatcttctttgacttcaaacatcacatcgctggcagacacatagccatcttcataaggagccagttcctcatgtaaggtataacttccttccggcagtccgtaaatgacatgttcttccttactgcttacccattcttccacaacatttccgtctttatcaatgacctgcagtttggctccttccagctcatttccggtagttgcatctgtttttgtaatgcgtgtttctgtcggctgattctcaacttctttgttcagttcaatctttgcaagattctgattttcgtaagttgcatctacattccatacttcctcatttggaagatatccagcttttctgacttcctctttgacatagtattttccatgtggaagatcactgtcgaaagtaagtgttccctttgcatccgttgctttcttttccagcaaggtatctttctctacgagaacctctccctgattagaaagaatatcttctgcagcatacagtccaaaaataacaccttccagcttttcgcctgtgacagaatctttcttttctactgatacgaaaactttctgtctttcatttttataggtaacgccttcataaacaactgcctgtgtatcatcctctgctgtcagggtaaattctttctgttctgtatttaggacaaaattctctcctgctacaacttctttcagataatacgttcccagtggcagattgttgataactgctgttccattttcatctgtagtcagtttggctaccaggtcatctttctcatatcggacaactggatttcctgcttcgtcctttgctccgtccggtgaatagatggtatctttggcatatatttcgaattcagcgccttctactccggtttcttcatatttaaagcctttataaatacctgtttcttcttttccagatacggcatttcttacttttgaaaccagtgcttttacttttgccagaacagaatctccggttacttcggtaagctgttctccctttttcgtcaggagcaggcttcctacctgttcatcgtttttctgttctacctctacaatcgcagctcctgtatctggatcaatctgatgtgcagtgtttgaggatactgtaattacaataccactctgtggattttctttatatgttccttttgtagtctgttctaatggtgaaataatcgttgttccatcatacagggactcctcgcttccctgtcttacaaatccttccggtgctttcacttcttcgattcggtaggtagagcacttcagttcctgcggtgtgatcagatatccttcctcgtttgtttcgaatacactgatcttttctttcttcggatactgaacaacctgttccacatatttcttatttgtcacatcgtaaatcttataagaagcaccagcctttaaaacagtatttccagtctgtgcatccttctttacaattttcagcaaaaattcaaacgggcggtcatcaaatactctccactgcattggctctctgctgtcattttccacatttacaacaaatggatcaatggttttcaaattctcaggggtagtactttccactacaacataacttccatacggcagttccgggctgactgcatatccttttgtatcagtgatcagttctggtactggtacggctgttccattctcgtaagtaactgcaacctgctctttgctgaagtcataatttttgaaatcgcttgctgtatagctttctccattggctggcttcagttttccattttttacctgtgtcaggtcgctgatcagatataccttaaatcctgctcctgcaaccaggtctgtttctgtctgctctccatcttcactgattttgattaactggaatgcctgtttctttacctgctcttttaccgtaaggtctcttgtcacttcggcaacatcctgaccttcataagttactgatacctcgtatttggtagtatccagtgtatatccttccggtggagtgatctcttttacatacatttctccaaggtataattctgaaaattccagtgttccgtcatctccgatgactccctgtgcaatcaggctgtcctgtttatacagaacccctgttgtgccatccggatgcacgatgtcctcttttgcatacagaccatacacagcaccacgaagaacactgtccccctgcgctttaaatgcaagtgtttctttatcgatctttgcgattttcacctttccggtgactctctcatctgttgctgttacagtcattgtctttccggcagtaacagccactttatatacttctgtattcagtttgtatcctgtcggagcagtgatctctttcacgtacactgttttcagtgcagaatcaaaataatcgctgactgcttttccgtctgttccggttgctgacattgtcatcagcagattttcacacttcttatcagtataaataccataaactgctcctgacagtggattctgtgtattgacatctttcttcataagttcaatgcgtgtcatattcagccactgtacactgaagcttaccggcgctgctgtttcgctttcaaatacaccgatatcctgcttggaatctccggttgtcaacaccagtgttctccatgtctttccgacagaaccatataagttgccggaagcataactgcctgtcagtaataaatctgcggacagatagaatgtatctccaccataaatctggatttttccatttgtaacacttgttcctttggaaagattatgtgctgtcacattttctggtacactcagtgtcacatagtttctgtgatctccagacagtgtgatatttggtgttttctggatgtttccatcccgtactgcattcagctttgtgcttgaaaggctcagttcaccttttggcggttcttcctgtccaaacagataattgatatatgcgataacccctgcatttacaaggtcattataattacaccctgtaaatccggcttctcctgcataagcatagctggctgcaatgtgtgtatacacatacttttcatcttccgtttttccagacagataacttcctgtcagatctcctgccccgccataaccataataaaggactttctgcagatttttattgctgtccagtacctgtgctacataacttccactcggtggggatgctttctgggactgaaggcagtatgcaatttttccattgactgtaaacaggcaagtaagataatttccaatataacttggataataaatagttctcccctttgtcaatgtaactgtggaaccgctgcttgtagctctttcagccgcagacaataccatcacatttccctcttcgatgtcctctttcagttctttgattgcctgtgcagatgcatcttcttcggatgtttcaatttctacatctgtgtagttctgcacaggcgaatccgaatcatcttcagattctgtatctgacttctgtttctctccaccattttcttcggaatgtgcctgtccttcggtatccgtcagagtcactttacgggtgatggtatagctgtcactcttatcttttggaacgaccatataagtggcaatatatgttcctgctttgtctgaatgatactctccaccattctcatctttgatacttacaagcgtaacatcttctttttctgcatcataatggattccttccatactggtttccactgcaaatgtatcatctgaaactgcttttgtgatatcatctgctgtaactgatgtatctttctggcttgttaccgcctgttcagatgcctgtacttccgtctgctgttccgagcctgtctgttcggccgcaaacgcattcgcactgctcaaggtactgatgcccatcaggacagccagtccaaaagcagcaattctggtctttaattttctaaccttcatgtgcttttccttcctattataaatagattttttcagtaaaataccgcagaagatgtttcctctgcggtacgttttatcttgcatatcgatttttttctttttttacttcctgtctggtacgttttaccgcttccatgacagactccgttggaatctggttatccttacatccttccagaattccatccagataaaatttcgatggctttgccggaacatctttgtgcggagcgttcatcatatatacaaacacttctttctccacaccatcctgattttttacccgaatcgattctttcccataaaaacttgggaatccttcataaaaatccagactcttctcacacgcttctgtgattttccataagactccttcgacatagcttcctttttccggcagaaccgttgctaccccattgcccggagcccttccccgaaatgccagccgataattttcaagccggacgttttccacaacttccgcagccggacacctgtacttcatctgctccagattcatgttgctgccataagcgaagtaatatctatctttcattttttctcacctctatctgactccttctgtcctttgatttttcttcagacactcatacgtgcttttatcatatctccacgcaagatcaccatccagatttgccagcagatgttttcgaacatttttatattcgtctccaattaacccaagtctcaataaaaatgtacgaaatgtaaatgccgggttttctgatatcagtgtctttttcatctgtgtcgatctctgattgattgcctgtgcggaaatggctaatgccagtgtaatatttgctctcacctttcctgcatgtagtgtgctttcaaaacaacgccattccaaagttcccttggaaaacacagcatgaagattcagagcataataacgggtatgatcataatgggtatgacttccatccctgcctccataccagacatttcttactcggtccattgtgattgatttatttggtatttttcggattttctccaatacctccggtcgcaccctctgacaataactatttgctcttctctcctgcactttcagtgctttgaacaggatatcttcctttgcatacataattgtcagtgcatttttcagactctgcggtgtatgattcgatgcatctacatgaacatgctgaccacaggactcatttacaaaacctccatgctgtcgcagacatcgtactacttcctgtaactttcccatttcatcataggataatttcggtgataccatttctgttgaatattctccacctgcgtctacaattcgaccgtatactttccgttgtgtataaatgctcccatcagacataaatttccacttttttccttccagatctatcactgaccagactccataagtagtgccgtcataatatgcttctgttccaaacatttcagcaacaacttctgcagcacgttgtctggtaatccctgtcatttcgatttctgtgccaaagtattggtcttttattccgatcatgcctaatggattcctttctcagacactttctgtgtgttaagttcggagtctgccttttgtaacaatctgccaattgcctcgataacattgacagttactccgtttccagcctgtttataaagctgtgcgtcagaagtgctgtctatgatcttatcaatctgccagtcgtaataaccctgcagtcgcagacattccctcggaactaaccttcttattctgccgtgatacaagatgccatgacgatcggttgcagtaattgtaaacatcggttcttcgggttctttcatacgtctgccgttctgacgaacattctcttttgctggtgttaagactgctcttgctccatcctctgctaatacaccagaacattctcctttgtatttgtggacaccgcattgtctggtattcaggcttctgcattcttccgttaccaccggcggaggtgaaagatcgacaaagtgcagcgttccctgttgaacacctgttgtcagggtatgtgcgatctggtgtccgactcttcctctcctgctgttgagattcgcataacccagatcgatgctgtccccttctcttgcaagtttgtagccgagctttgtattctctttgattggaacacctacatcatataatcctgtcttgccgcccattccacctgcctgtgatgtcagggtacagcttagtcctttgggactgtagactcttttcccctgacttcctgcccggacttgaacaagagctgctccatttgtttctggttcaggtaatacttttccggcacatcggaaatcaaaatatccgacaatatacacccgttttcttgcttgggggactccgaaatccttgctgttaagcactttccattcgacatggtaccccagttcagaaagcgtactgaggatggtgcaaaacgtccggcctttgtcatgcgataacaaaccgggaacattttcaaggataaaatacgagggtcttttagcttcaagaatccgggcaatttcaaaaaagagagttcctcttgcatctgcaaatccttctcgctttccggcgatagagaatgcctggcaaggaaatcctgcacagagtaaatcaaaatctggcattcgttctggttcgattgttcttgcgtcattacaataccactccccttccgtatcaaacagcaatcggtagttcttatccgcataagtatccacctcgcaatgtccgacacagacaaagtttcctgcccgtcttaagccttcacgaaatcccccgattccgctaaagagatcaaaaaattgaatggttgcggctatcaacctcctttttgctgataaaaacaggcggcatgatctctcataccgcccttcgttattctgtatcaattggttaccattctgttggttcttctgctttggattcttcttccagatcagtttctctttctggttcagtttcctcttccggttcgctgtccccttctggttcgttttcctcttttggttcgctctctccttccggttcgttttcctctttcggttcgctctctccttctggctcgctttcctcttctggttcacactccccttccggctcagtgctttcttccggttgagtttcttctgttcccgattcttcggttgtctgttcggattcttcaggctgttctttgctttgccattctgcctctgccttttccagcgcttcttctataatctgaattaagaagtctttctgtttcatgtgtttctgtccgatgactacttttaatctctggaataactcctctgatacctgtactgctactgttcttactgctcccatgcttatttctccttttccttccagtctgttgaaatgttcttcaatgacctgttgtaaaaatttttgtgtgctgctttctgtgagttcgatctcttctcttactttttcatgtaagtccatcgggatctttccgcagatatttttcatctctgccataacttttctcctttctctttcgctacacacaacatactccaaagccgcatggaaagctattcacaatacccaccaaagataacgatacatttctgtccttacccctagcagatccaacaatgtatgtatcgtgcaatcataggcctcaccccctttacaaattttccatttgagataaaaaatccatcatctgagctggtatttcttccgatgatggtttcgttttcaattgttccgtagtgccacatattcctaattcccgaacactttcttttatcgtcttttgaatgacttcttccagccatttccgatcctctttttccagaattgcctgaaccagatactggcttttctgcccttctggaacactttgaaatttctcccatgccctctggtgttctggatttttcaggtttgggcggaacgaatataccggacgtgtcatctcgcccacatctgctctacaatccgttcataccctgttgcgttggcatggacgtcctctataaaaacggggcggcaaatcgcgtcctgtgcggtcacgtggcgttttaaaattgcggagcctccacccataaatacggttggtactgcccggagatcaaacccagattctgtcaccgcagacaatattctttctatatatttccgtccgctttcctgtataatccgtctgacctcctctgccatactgcaagattccccccgaagcacacgctcaatttgagtttctgttacagacagtccggtatttctacgcacctgttctgctgtctcatcaatacatcggatcactccaagctccaaactcctgcacgttgctgcattcggaacagcattgtccagcctcataaggtcaacggtccagccaccaatatcaacaagcagaacagacggttcatttttcagatactctggatgaagagcaagcgcagagtatccctgtgggaacagtttcacatcttttattgttatctcatataattcactttcatataaaaatcgcactggctgctctttccgcaacagatactccctgaatccctgtttctctcttccgaaacttgaaagcggaagtccgacagccagaattacctctgtctttcgttccgctttccgatgcttgatttcttctgcaatggctgccaacgtcagcagataataattatcattggacgttttattttttaccagcgtctgtcttcccgtaccacagacataatactttccctgatactgcagaacattctgcatggtatacggctcgtaatcatacctgataattccacttgggaaagacacttgtcttgtttttattgcataatagccatgatcaattcctatgattatcgcaatcacatcctttcatttttctgtttaacgtaatgtcaaaaatgctttcactgctgcaacggatcgttgcaaaagtgccattcgtgaacacttttctatgttccagtgtcccaaaacctgcggaaaatctggcttttttataccactatcgccagaggaacactactgttccttcccagccggttataaaagatccctctcccggtggcggttcggcctgtccgggggagggatatatcgcaagtttcctttttgaacaattgcctgtctttttatttttatgagatgtttttcctgcttttgtaaaatgggaagatactccggttctgacaaaaacttccgtatataattccccttttctcccagcctgttatcattttctaacagctccatttccaccatgtaatgggtatctggatgaaatctcttctcacacaaaatgctgtccccttttatataatcagatttagccgattctcttgctgccgccaagagttcataaatacttacttccacctcttatcacctcccaaaagaccagaaaaaagcagacctcttaatcgaagtctgctcctgtcggatatggtaatcctctttcttcatattttttatcgatataatttcgaatccattccctgtattcttccgttaatgccagttcctgaaattctaacaaccacttttccccttttgcttcgtcatcaagccatcgatcttctatgcactccggctcatctaacattttcatcatcgcttcaaatggctcttttacatcatcaccaaattctttccataaggcgattccatagttctccagttcaaaaaattctgtcagatatgtcaatcgttccatatcccccaatgtcattctttttttacctgacaataatgctcgatctcttttgccacatagatttaaaaattttctcttttccatctccacatccattatacttttacctcttcctgttaaaaataattccttattacgaaacattataaaatttaaattctttagaatcaatatatatgtttctgtattacgaaactttttattttataaggggagttcatcattatgcaaaagattagaccagatatggatattggtaaaaatatccaagcaattcgatataaaaacaatatgactcaagaccaagtagttgcaaaattaaatcttatgggtatctccatcaccaaaagtacctatgccaaactggaaacaaatcgcatgaacattaaggcatctgaattagttgcacttgcaaaactctttcataccgatatcaatgctttcttttccggcttgctatagttcgacattccccgactccctgtgtatataatagcatattaaaaataagaaccagtctatattcttatcggatataaaccagttcttttttcttatcaaataatataaaagtgacagggaattcagattcttatcttctgtcactcatgtaattattattctattttaaatttaatgaatttacccattcttgaatttcttttttcaatgttattttctatataaacgtcatacacatttttccacattatctgtgtatactgttattttcaaccccataattataacttgatacacgctatacactactataaactgtactccattttagggaatcccagaaggatctcgtcataagaactcatatccatctcttttttcataatcgccggtctgtatttcttatcactcatttccacactgcttcgggattttttattcatccagtcaagatcagcctttgtatatggaactttcggcttaatctcaaataaatccgcctttacttcctctgcgatcatctgtgctactttttttgttgttccgcttgcactgaaaaatgccactaattttttactcataataaaaagcccctttctttacgtattttccacaaaaaaatagatgtataagatttacattcatcttacacatctattttaagcactatcacttcattatgtctaatgcttatattgaattttattttatgcctgaaaagcattaatctcctcgatcattttacggactgccaaagaatatggaatattccgtcgccaggcaatcaccgtactggtcgtgatttcaggagaaattcttcgctgtacaagaatatcctctcgccaatactttgcagcaccctcaattgaaattggataccccagtccatttgccgccataactccggcattcgttccaagattactcgtaaaagcaatctgtaattttgaaaagtctttcccaaaccagttggcaagttcactttgaacgttcattctttccggcaggatcaagggctttccaataagatcttctttttttataaactctttttctgccagcggatcatccggccgcattccgacacaccagtgatcgcaatctgtgatccggatataatccagcccttcggtgtccaccggctccatgaataatgcaatatctacaagccctttgttcatcatctcatacactacatctgctgttgcagtatgcaatacaatctgaaccagcggatatttttctttatatattttacatatcttcgccaatgtctccactgctgcaaattcaccgcatccaatggttatcgtactctctacaacctcttcttttcctttcagttcctcaagcgtcctttcctcaagattaagaatctccaaggcacgcctttttaatagaatcccctcatcagtaagcgaaattttcttcccacttcgaataaataatgttattcccaggtcctcttcaaatgccgccatttgtctggaaagcgttggctgggtaatatgcaattgttctgctgcttttgtaaagctctgttcttttgctactgttaaaaaatagcgtaatactcttaattccatatctttatattcctacaaatttttcttgtaaccattctatcatgttgcatcccaaacatcatctatatttacatgtaatatctgcacaaaataccgtggtttattttcgcataatatcatccgcaaaaggtgtaaaaatggattacaaatcaactgcataccacatcacatttttccaacttgtcatatcgcactatccccttttacttttaatacgtagtcctaaaataatccaaatatgctttatatttatcttgtgctgtcagacaggtatctgtcagatatcctttttcgttgtcccattccttcaatccacgataatagaacatcttcaaattgtcctcaatgatgaacggaacaatattgtatttcaggcactccttaaacatgatcaatctgcccacacgaccgtttccatcttgaaatggatgaatccgctcaaacttcacatggaagtccagaatatcctcaaaggtcttttcttctttggtgctgtattccgtcagcaaggctttcattttatcggcaactttttccggaagggctgtatccctgccgccaacttcatttggaagtttcttataatcaccaacagcaaaccaatcttttctggaatcgctggtgccattcttcaaaaccaagtgaagttctttgatgaacttctccgtcaaagctacttttgcatcatcaataatcatgtcaatgcaacggaagtgatttgctgtttcagcaactaaaaggtatttcatctacaatcctccatcacaaaccataacccaaattcaaaacatactaatctactaactagtatatcacattatcggtaaaagcatcatcagttttacccatagtaccattttttagccgatataacgactgtctccttattacttctgataatatcgacaataatttatcaacctggattggctttgctatatgtccattcattccagctgcaatagcatctctcttatcttcttcaaatgcatttgctgtcattgcaataatcggtatactcgctttatccttatctgacaatcttgtcttattgctttatccttcaactcgtctgcatttcctgtaagaaatgatccatatgctcttccagtagttttatcacatggctcttgtcttctgctccatcatatatgctgtaaagcaaaaaaataggtccataaaaatcaagtgctgtctgtctggcttttcctgcatcgcctaacattcctgaaaacaaagcttccatatatgttaatggtccgctagcaagataattctgatataactgtgccatctgtggttccctgtactgttccaatgtcagcatcttacgaaaacagcttgaaaactcttcctctgtccaatgaagaaactgcacctttgtgaactgtttaatcttatcaaatgccatttctttatattcagctataaccttttccagatcaccctccggtatttcatactgctttactctctcaatatccaatgcattcattttttcaataatactgtccaatatctcctgcttgcttttataatgcttatacaatgcagccttggtcactccaagttttgaagcaatatcattcatggatgttcccatatatccactctgtgcaaataacttcagggcttcttccaatattttttcctttgtgttcttttctttactttccatatatatctcctaatttaaatccgttatcaagttaccttttggttactttaattatagttacctgtccgatgacactgtaacaatataataaataattccaaatacagctatacttcccagcataataccaatcatctgatttacacttaccacattttcatgaaataccggattgcaatcaagagttctttttattacatcaaccatttcaccaggataatgttttctctccatctccacgaatactccgtaaagcatatgattcttaatcaatgaagtggcatatgtacttggaagataagacagcaccttctgaagacctgcaccaaaattcgaaatcggcatataagcaccacatataaaaccatatcctgcactgacaattgtacctacagccgaaagctgtccctgtgttgttaatggaaagctaatgatacttgaaagcgtacttccaaacagaacgagcaatatcatatcaaatagaacccataatacatctgctgcattcatataccatcccattttaagtaaatatcccaggcataatacaaacgcaagtccattgaccatcaaagaattagcaactgttgacagaaaatatcccaaataaatttttccactgctgacaggtgaaacatcaaagtccttccttgttccatttgccttgtcctgcaccatagtcagattcacacaaaatgttacagtaatacaacttactgccataagtgatgctgtcagctgtgctgctactgttccattaatgagcttatccgaaattgtgatcacatccggaatcgctgctgtaaaagaatctctgaaaacctttgcaagaaacgtagcatacagaacaatcagaatgacgggtgtgatcattgatgtaaacaacatccctttatctttaaaaaacagtttcctattcctgttcattaacgccaatactgttctcattaatgctcacctccaagcttcttccctgtgactgcaagaaatacatcatccataccgccttttactacttcataatccatgaataggtcctgatgctctacaataagcttcgtagcttccttcgtatttcttacttttatctgatatccgtcacgtatttttttatattctctgttcaatgactttatttcatcttcggaaacaccataaacagacactatatcctgtacataatcattcttaagttcaaacggtgtaccttctgcggcaacacttcctttgtcaagaatcacaacataaccagcattggcagcctcttccatataatgtgtagtcaaaaatactgtcatattttctgttttctgaagcttctcgataacattccagattaactgtcttgtctgtggatcaagccctgtggtaggctcgtcaagaatcaaaatttccggtctgtgcaataatgcacgggcaatatcaattcttcttctctgacctcccgacagcttacctacaggtctgtttaaaaactcgtcaaaatccagaatctcgaccagctcctgtaatctcttatcaaaggcatttcctgtaattccgtacaaagcagctctgctcattaggttctctttcaccgtaagtggtttatcaagtacgctatcctgaaatacaacaccaagcatcctttttgtctgtgcgccggctttgtcagtttctattccgtttacctgaaccgttccactgtcttttttcagcagtccacaaagaatagaaatggttgtacttttccctgcaccgtttactccaagaaaagcaaacaattctccttttttcacacgaaagctcaaatcatttaccgcttttacttcgccaaagcttttattcagatggctgattttaattatatctgattccatatattctccttttgttttcatttttctttaaatgtcacagtatatattagatttacctttactattcttaccttcattttcttcataggttaccgtttggttacttatattatagtaaccaaacggtaacttgtcaatcttttattacttataacaaatgaacatgacgaaaaaacagccaaatctcccaatctgctcaaggcatcctggacgatacacatcccaaaaactttctcttaccagattttctactttctgatgttcttcctttttctctaaacgaatctcaatattacttttttccatttcttttatgtcctttcttaaaaataaaaaccgataatcctaatttttcagtatcagaattaacggctctgcgtcttaagcgtctggctcttatattactgtttcatttcttctactattttatctagcatctgttcaaactgacattttgctttcgccttatctgctgcaccatcatacacgttataatagaaaaacatatttgcataaaatttaactgcattctcctctggatcttttattttcatatttttgaacagatccttcacgtatcctgccggtccagataccagatattgctgatataatttctgcattccttcactacgaaactgttctattgtcagcatcttccgaaacgatgatgcaaaatcatcctctgtccagtattcaaacatagacttactgtattccacaaaatcatcaaatgatatgttctggtattcttccggtgtcttttcaatactctcttccggcacttcattctctctggcctgttcgctgtcctgctgttccattcgctttacaatactgtcaaaaatatctcttttgcttttataatgacgatacaacgcgccttttgtcatatcaagctctcctgctatctggctgactgagacagcctcataaccatctctggcgaacagatgcagtgccacaattaatatttcttctttcctattacccatgcacatttcctccaaaataaataaacgaccgtttacatcttaataacagtaaacgatcgtttatttgtcaatacttttctttttgtttatattatctctttttataaatcagaagttctggattttcaccatctttttcatatgtacatatgatgataaaatccatatctgccagaataccaaaacaccggtctcctccgaattcagactccatttgatttcccaaataagttttctgatcatccaaaaactttactttttgtccatttggcagttgatattcaagattcacatatttccccacaagtgcatttagtttgtctactcttggaagtccgtctatatgcagatcatttatttcgttcatcaattgctttttaaactcttcaaactgcccattgtcactgagttcatcatatcttttccagtaatctaactttggaagcatttccttcaaataagagcgtgcctgttcttcggtaaagttttcatttaccatgttctttacacatacatcaatcaattcatccatatcattatatgtgtacgttccatctgcatagcaccatttacaatattcctcattcaatgtaccatctttgtcacgtcccaggatagaatcatcatccatcggcattccacagcactgacaaatcagctttctcggttctcccaaaagcatattaattgaaacatcaaattcttttgataaaagccttagtgtatcagtattcggaactgtatctccattttcccaacgggatactgcctgtctcgtcaccataactttatctgccaaatcgtcttgtgacattcctctttctgttctaagcttaagaattatcttttttgtttccatagtcgtcacctccgtcatctttatcatatcgataaatctgcagtctgaaaagcaacctgctgttgccataatctatctatttccttccaatccaggcatctcacaaagctttcatctggaaattccacctgcttgttccacggacgatcatatacagctactttacaatctttaaaatgctgcacatgctcaaacgcagctggtgaatcttcgattgcaaaatcaaaatgcatgcaataaagttcttctaatgtcagattataggtatgatcctgtttgcacatttctcgtccatatttatcaacaaaataaataggaagcctatttaagtgatgttcatccaaccatcttctagatggttcataagaatcaaatggtcttcctgtgaccacaaaaacctcatgtccttcatcaacccacttgttgatcacttctgaagctcccggtgtttcttcataatctagtaaattttctggaatatgccctgccttcatcaattcatcatactgttctccacttagatcaaatgatttctgaagattaaagaactgtacttccctatatggcacatcaatattaaataattcttttgcaatttgggtaaaatacttcgctgtttcacagataacgtcatcaaagtctatatatattttcatcgctacatcctttccagtctacatatatattttagacatcccttaaacatgatcaaactatattatcggcaataattctattattccttattgagtttcatcatttttaccgtacctttgcctctcgtgatccagcaaaatgtacatacaaagataattccttttacaattgatgttacagaaaatgcccaccagataccttccagtccaagcaatgctccacccaaaatgattgcaagcggaattcttgcactggtaaatagaatactgatcacactgcataaatgtgtttttcctaatcctgataacgcacctactgtcatcagttctacagccataaacgcttcactcaccccaatgatcgtcaaatatccgatcgcgatcataattgcctttggttcatggaagaaaatctctgcgattgcctttggttgaaaaacaaatatgatcgtaataaagattccccatattccaacgctgcacaaagaggctttgtatccttttttgacacgatccatctttcctgctccataattttgcccgataaatgcatttagagctgtcccaaatccatcggctgtattccatgaaacagattcaatctgccctccgactctctggactgcaactgcttctgctccaaaacctgaaaccatacgagttaataccatggaaattccacagtaaaccattccctgaatcgctgtcggaataccaatcttgcagattccacttagatatttaaatggaatttttgtaaataacttgattccttttaatacattttgttttttctgtcggataattccaaggatcagaatagtcataacaattgcctgtgcacttactgttgcaatcgcagctccattcaccccaaacttgtttactggtccaagccccaggatcagtaatggatccaagatcatattcgttacaagtcctataaaattagctataaatggcgtctttgaatctccttgtgctgtatagattccagttaaagtgagtgtcaaaaatgaaaacacgatcaatccacaggctatttttgtgtaagataatgctgcctgcaatgcctctggatcttgtagctgaaagaatcctaccagcggatgcaaaaacagtaacatcactgctgcaaataaaagtcccataagcgttgccagctgaactgctgtctgtgcatacttatgggcttcttctttgtctcctcgtccaatgcattgtgctacctgtacctgtcctcccattctcgacatcgaagctaatccttgtgaaaaccacgtaaacatgcctccgacaccaactccggcaactgcttttgatccaagaagtccgatccatgccatatctgtaatattgtataatgttcctaaaaatgacgatgccatgattggcaccgcaagtttcgttagtgtttttaaaattggtccttttgttaaatttccttccaattacttttctctcctgtgaatttatttttgcgaccatatcattacatattcttttactaattgaaaattgttcttccaatacttggcagaaataaaatcatgtgcttttaaatttgtatctaaccatatatctgcaactctatttatatctgttttctgtaatttcctgatcataaaccacatacgaatcctcctggccaaaaataaatttttaaatatccagattttctaacacttctttcaaggcttctgctgatttcttcaatgcttcctgttctttttcattcagcttgatcgccagttgtttctcaataccattttttcctacgatcgctggcatacttaatgtaacaccttcaattccataggtatcatgttggatagaagatactggtaatacagatttttcatctcggatgattgcttcgcagattcttctgacagccattgcaactccataatatgttgcttttttcttttcaataatcttatatgcactgtttttgactccctgtgcaatctcttccatatgctcgtcgtgttctgtgtaacctctcatctcgcaaaattctgaaattggtacgcctgatacattggcacttgaccatgctacgatttcagaatctccatgttctccgatgatccatgcatgaacagatcttgcatctacctgtaaatgttctccaagcagatattttaatctggcagaatctagggttgtaccagaaccaaagactctgttttcaggaaatcctgatagttttactgcaacttgtgtcaaaatatctactggattggctacgatcaaaagaatcccttcacattttctctgtgcgatctctggaatgatcgattgaaagattgctacatttttcttgacaagatcaagtcttgtctctcctggtttctgtcctgcacccgctgtcacaacaatgatcgctgcatccacgatatcatcataatcgcctgctgtgatcttcattggtctggcaaatgggagtccatgggcaatatctaatgcctctccttctgcacgattcttatcagcatcgatcaacaccatttcagtaaataatccactttccattaatgcaaatgcagaagatgaacctacaaatcctgttccgatcactgctacttttctgctgtttattcctttactcattattgggtctccttttacattttttagaatgacaatattatcacccaattccattatatcaattcatgcaaaaagatttttactatattgtttattatatactcttatgaatacattgtactaatgttttttcaaccttatcaatctgaaatggtttcgctaagtgtgcattcatccctgctgcaaaacatttctttgcatcttcttcaaatgcatttgctgtcatagcgatgatcggtatctgtgctgcatcgtctcgtttgatggatcgaatctccttggtcgctgtcaatccatccataaccggcatcataatatccattaatatcgcatcaaatgttccttgtggagcattcttaaattgatccactgcccgttgcccatcttccacaacagtgacattggctccatcatccgtcagaagtgtctgtatgatttctgcattcaattgattatcctcggcaactaataagtttaaaccacgaatatctgcttgctccactatcttctcagccactggctgttctttcttctgtgcgatttcaaatggaatcgtgatcacaaaggtagatcccattcctttctcgcttgtcactttgatttctccatgcatctgttctaccagtcccttaacgatcgacattccaagcccagtcccctgatatacacttcgggcatccgtcttttcctgtgaaaatggctcaaaaatatgatcgatataatctttactgataccaattcccgtgtctttgatcgtccaacgatacgtacagatcttatcatgaacatccatttgttccatctttgtagaaatagttccacccggatgattatatttaatacagtttccataaatattcaataagatctgacgaagatgcaatgggcttgcatatacatatgaatatctgtcatctatgttatcttcttcatagttccatcggattcctgcctctagaacccgctctctgatcatcgtctcaacttcccgcatcagtttcttcacagtaatctcttggtgtgccagtgtgatctgaccttcctcgatcttactcatctgcaatacatcgttgatcagagaaagcagatgtttggcagcaatttccattttcttatgattctctaataccagtttctgatcatcgaaatgtttttcattgatatttagaagtccaatgattccatttaatggtgttctgatatcatggctcatacggcttaagaaatcggtcttcgcctgacttgctgtacgcatttcgtcaaatgctgcctgtaaacgtgcgtgttctaattcttcttgtttatgtctttgcgatgtatcctgtaagagcatgatcgcataaactgtcggaatctcgctcattgtctcttcatcgtataccacgatctgtgtcataagaattgttttttgtacccagcgaatacttccatcatcttcatgaaaacaatattccacagaaatatttgtgtcaccattgttgtatctctccagcagttttttcgtatcatttgtcatattatactctgcttttgtctccttcgtgacttttttctcatattctgcgcagtaatcctgataattacatggtaatggataatcaagaaacatctctttgttcttttgctcttttccctttagaataatatttctctccagaatatctgtctttagattgaccgtatagatcacatcggataattccaaaagtgcatcgacataactgtcattttcaatgattgattgttttagctgttcataataaatctgtaactgttctctggcccctgtctgattgtcagctccttttcggatgatttcaaatgccagaagaaaatgatgtaatttcttatcttcatcccagtcaactgggatcaatgtcatacgcttatagaatccttcttcctgcatatcatattgatattcctgtacatcctgtttctccttcatcttctcttgaagtcttgtaatctgaagcctttcccaaatgttcttctgctcatctttcccaatcttttcctgtacgatctgctctactgcactggaatacgcaccatctaaagctaagaaaaagttttcactggaacggatcacacgatatgtatccagcttagcatcacaatataaacagtctaaaaagttctttccatgttgattcagcagttttaataattgataattcaaccgcttctcttcaagtgcttcttcccgtttcacatggtttttattgatgtacatatttttatctgcatcattgaataattctctcattgttttgccaggataatcacttgccatagcaaaacccgctgcataacttaacggaatctctcgatgttctttggattctgctgctatatctttgcgaagatcttcaaatagctttctcaccgcttgtttatcaagcccctgcagcactgcgataaattcgtctcccccaagtcttccgacaaaatgttccgatggtatggaagatcgcagacaaacagcaaaccgataaatatacgcatctcctgcatcatgccccatactatcgttgatccgacggagattattaaggtcaaaactgcatacgataatatcctctggtggattcagttcacctaatatctcttcacatttattcttattcggaagtcctgttgcattatctaaataagctttatgccgcaatatacggttcatcgccgcaaaacggaccgctttaataaactcatatccgatcagcagcatcaatacaacgatatctgctgtgatgaatttctcaagagttgctaatgacgttgcttttctctgtgcatatacttccgcaagacctgttgcctcatcacagatcttaaagaatctctcgctctttgaaatgatatctgtatgctcatagccgactgtccgcacacgataaatttctttgtgtaaggaaataaaatattcatccagttccttcatcttatcctgaaaatcatcatcctttaaccgtacgagttttaattggtcattgccatgacgcagcccttcgataaaggactgcacttccttgatcagctcatcttctcgctgtccggaattctctaacttaatgatcctttgtgtttctccccttattaaccccgcataatttacaacgcgggctgttccctgaatgttcgagaccaactgcatcaggatgacgataaagaccactaaaagtaccgtcagaataccgatgccgatacggatcatatttggtttttttctttttgtcgtatcagacataaacttttattcccctatcactactttagaaaatttcttataacatgcaatcccatacttgatgaaatttatcattccatcctgctttagtttcgctgtataatctttttcctcaatctgtcttaatgcttcatcacacgcagcatccagattcccatcttctgcatatttaagttcgattataatcccagttctgttcatcggagcttcaatcaaaatatcactgtatccaatccctgattcaacatttgattttatcagccagttggatttatatcctaaaagtccaagtaaaatgccatggtagaaattttccttcttttctttggcaactgctgtatcccttatactgatcgtgttccagagataatctccaaaaatctgtttcttctgattttttcgaaactatcaacacctactggtaatttcaaagtgtctgccatatacacctccactatgctcgcccatggaaatctttcttttatgctataatttacaaaacattataacatgatgtgtagtgagatacaatcaaacaaaaatcttccgtttatacacgattggatcatcatatccaaatgttcttcttccatttacttctatgatctctgatacctccagactatcctctgaaaatctttcccataatttaaagatcataactggtgaaaactggcttgtactgccgccttcccagacaccatccttctcgcgataaagtgctggtgtgaatttttttgattcgttcagttcactgtaatctactgctttcatagaatcataagaaaatgtattcttatcttctccattcggaatatcgtaggaagaaagtacaattccttcattattttctgaaataagaaaaagatgcggtgatgtgtggctttttccatctgttttatagtaactttcttctacaacaaatgtaccattgaagttttctgggagatttttgattttatcgttacatgctgtattgatgtgttttgcatatggataggtttttccttctgtctgcattttgtcaaattgttctttgttgtcaaaatgaccagtcattaactttataaaatctgtaagtttgctcatgatcttcctccgtaaatttaaatttctttaattatactcttgtgaaatttttttgtaaaatattttcctatgtatttattgaatatccgctaatttctttgtaactctaacctgaatttccgtatagtatgataattctatttcatcgccattattattttttgcttcaaaatattttatgtcactgtcgtcagtttcaatatctgaaaattttgtttttactttttctacatatgcttcaaattgtctacgactaaccccatatccattaaacgaaaaataagcactaatcctaacaatattttcttcttcatattcatttctccttcttttgtttggttacaattgtacacttctgaataaaaagaaatccccaccataatggtgaggatgtaataaatccgttattcaattccttttgataatttcgtcaacctttgattttccaatatttcatcgatatcgcccagatcatattttctgtagttcactgctacgatgatgcatgcatcccgcttgtcttttgcatataatggtttcatcgtacgcttttccatattcagtatcttttctgcaatgtaagatttgcatcacaacgaggacagaattcatcgccctcatctgctgctcaaatcagtctcttctccaaacaataatgataaattccatcctccgaaacatctccacagatttcatctgccactgctttcagatcatcggatgcatttgccattgcaattccattgccaactgcttttaacatctcgatatcgttattgccatccccaaatgccatagcctgagatttatctatgccataatgttttaacattttctcaatccctgctccttttcctgcattgaccggtatgatgtcaactgctcgatcccaccatgccgtaatctcagctccctggacaccttttaagatctcttgatactcttctactcttgcacccatcaacacttgataaactttttctttttttatatcttcgaaatcttctgctacatcaacttcggcattcccaaatgcatagtaatcgatcaagtcctgatcttttccatttgcagccatacggtctttcgttgctaatgcaactggctttcccattttgtctgcatttttaatgatcctttcaatatcttttaatggaatacaattgctatagagtgttccactgtgatcatagcaataagacccattgtatgtaagaaatgcatcaaactcaactccttcaaaatgtgggacaagcatcggtcctcttcctgttgccaaacaaagtttgactcctttttcctgtagtcgctttaatgcttctaatgttttttctgaaatcgtatcttgatccatagcgatcaatgtaccatcaatgtcaaaaaatatgattttaatatctttcatgtctttcttttccttctatattatgatgagagtttacgctaaataacgaaatgcctgtatgatataagacaaaatcttgatcataccctgctttttgctatccatcgtgcgttctgctacatccttgtcattttgataacttccatcttgattcactttcaaagatccgctttttaatctgctaaaatcttcttccagctgttttgtgatctcttttccttgtacaacaagcatcgtttctgtgtctacataggtacttctgcaatcaaagttataagaaccaaccactgctatatcatcatcaatgatcagagattttccgtgtgtggaatgtctgcccatatattcatacagtgacactcctgtacctaaaatctttgatcggttcttttgataatctgctgatgcacaaatattatctcctgatgcgattgaattcaagatcattgttgtgttcggaacctgttgtttcacctgtgcgatcccttcgtacatttctttggaaaacactgcatatggtgtatgaatgataactttgctttttgcctgtaacatcaactgcttcagcgtttcaaatacaactggttcttttccataaattgttgtcggattggttaccagtgttgttttcttcgttggaactgtaatcttttgataatcataatctggaactctcactttctctgcatggaacaaaaggcgcttgacttccttctcttttttattctttgagcatgtactaaattttgttttgcagacttctaagttccagactttttgaaaatatcttctgatctgtccgaccgcaccttgatcttttgatccttgattgacgatcagaatctccctgtctatacctttgctttttcctttgtgtgttccaaggaaataatcaaacatatttctgccacccattaagaggtacttatgatctaccacaatatatttgtcatgcagacatccattgatcgtccatggtttcaaaagatttggcgtgttataaaaacgaatttcaacatttggctcacttccaactgctgcaaaaatatcctttcctgtcatatggatcgttccataaagcccatcaaccagaatctttatcttgacgcctcgtctagatgctttgagtaattctgaaaaaatatcatcactgctgcttccttcacggatatcaaaggttgatagaatgatctctttctttgcttttcgtatcatatccaaccgcagatcaagtgcttcctgattatcactgacgatctttgctcggtctgatccattttcgtttgatgttgaataaaacgtttccgtatgaatctttgacttatttgttttgcttaccgattgcatatgtacaaatggtacaagcattccaatgatcacatacaaaataaacaaaatcagaacgattcctgctatttttaattttttcattgttctaaaatccttattttaatttagataaataattttaccgtctttattttaacatctttaataatgattttaaactattgatttcataatcgggttttggttgtggatcttctgtcagatcttgtgctctgtgaaaccagattgtcttgatccctgcattgatcccgccttgaatatcagaactcaagctgtctccaatgatcgctgtattctccttcttaaaatctggaatcttagaaaaacatttctcaaaatattcaatgcttggtttgttatatccaatttcttcggaaataaaaacaccttgcagatacttctcaattcctgaactttttaatcttcctctttgtacagacaatgttccattcgttacaagatagatacgaaatctctttgataattcctgtaaaacttcttcggctccttcgataaaatagtgtccctgtcctaaatagtcctgataatgttttgccacttcctgtggtgatgcttttatatcaaattcttgaaataaaagcttaaatctgcgcatttttacttcttctcttgtcattttcccttgttccaacaatttccattgagcaagattaatcttatgatagcaatcacgcatctcattcgtcacagaaattcctacatcacctaatgcccttgtaattgcattggcttctgctttatcaaaatccagtaatgtattgtctaaatcaaataataatgtatcgatcataaatcaatctcccttttaatatatagtgatattataacatgatgtaagtatcaaaagtataaattatatttgttcttgcacatatatccaaaaagagattcatcataattgatgaatctcttttcgttagaatgaattgttatagattatatgaataatgatcgacttatttgtctttcaatactgcctgagctgctgctaatcttgcaattggtacacggaatggtgagcaggatacatagtctaatccggctctgtagcagaattctacagatgatggatctccaccatgttctccacagattcctaagtggatatctggacgagttgcttttcctttcttagctgccatctcgatcagctgtccaacacctttctggtctaatttagcaaatggatcagattcgtaaatcttgttctcatagtaagactctaagaacttacctgcatcatcacgagagaatccaaatgtcatctgtgttaagtcatttgttccgaaagagaagaattctgcttcttcagcaatctcgtctgccaataatgctgcacgaggaatctcaatcattgtaccaactttgtacttaatgtcagattcatagtaagcttttactttctcagctgtctgtacaacaacttctttaacatatgctaactctttcttctctcctactaatggaatcatgatctcaggaacgatatcatatcctttttcctgttttacttcgattgctgcttccataacggctcttgtctgcatcttggcaatctctggataagtaactgccagacggcatccacgatgtcccatcatagggttaaattcatgaagagctgcacgtctcatattgatctcttctactgtaactcccatatctttggcaagagctgtgatctcttccattgtatttggaaggaactcatgaagaggtggatctaagaaacggattgtgaccggtcttccttccataacctcatataaatctttaaagtctttcttctgataaggaattaactgattcaatgcgatttctcttgcttcttttgttgtagagaggatcatacgacgaatctttggaattctctctgcatcaaagaacatatgctctgtacggcaaagtccaataccctgtgctccgaatttcactgcattcaatgcatcggcaggtgtatctgcatttgttcttacctgtaatgtacggatttcatcggcccatgtcatgatacgatcgaaattaccactgatacttgcaggtactgtacggatctcacccagataaatcttacctgtggatccatctaaggaaatataatctccttcctgtactgtctttccacctaatgtgaaagatttgccatcttcagcaaacttgatatctccgcatcctgctacacacgctgttcccataccacgtgctacaacggctgcgtgagatgtcataccaccacgagctgttaagataccttctgctgcatgcattccttcgatatcttctggtgatgtttctaaacgaactaagataactttcagtcctgcttcatgatgcagtttcgccatctcagcatcaaaatatactttaccagcagcagctcctggagatgctggaagtgcttctccgattggaagagcggctttcaatgctgcctggtcaaagtttggatgcagtaactgatctaatgctttcgcatcgattcttgaaactgcttcttcttttgtgatttttccttcatctactaattcacaggcgatacggagtgcagctggggctgttctcttaccatttcttgtctgtaagaagtacagttttccttcctgaattgtaaattccatatcctgcatatcacgataatgttcttccagtgtatgagcaatctccataaactgtttataacaatctggtaaatcttctgccagtttagtaattggctgtggtgtacgaacaccagctactacgtcttcaccctgtgcattgatcaggtattctccgtagatctgtttctcacctgtagatgggtttcttgtaaatgccacacctgttcctgatgtatctcccatgttaccaaataccattgtctgaacgttaacagctgttccccagtctcctggaatgtcgttcattcgacgataatagatagcacgtgggttgtcccaagagcggaataccgctttgattgcttcaaataactggtcctttggatcctgagggaattcttcattcaaagctttgcgatagatacctttgtatctcttgatcacttccttcagatcatcggcatctaagtctgtatcaaacttcacacctttctctgctttgatgtcatctaagacatcttcgaatttcgctttatccacttcttttacaacgtctgagaacatctggataaaacgacgataagaatcatatgcaaaacgaggattgcctgtcttcttcgcaaatccttcgacagcttcatcattcaatcctaagttaaggatcgtatccatcatacccggcatggatactcttgctcctgatcttactgatactaatagaggatcttcaaggtctccgaacttctttccctgaatctcttccaagtctttcattgcttcaattacctgtgatgctacttcatcactgatttttccaccgcagtcataatagtttgtgcacgcttctgttgtaactgtgaatccctgaggaattggtaaattaagtcctgtcatctctgctaagtttgcaccttttcctccaagaaggttacgcatttcggcatttccttcactaaatttgtagacccattttgttgccatgtcaatacctcctaaaattaattatgtcacattcatatgtcattgaacttattgtaccacaaatttcagattttgcaaaacttttttgtgtattttacataatttttttcatttttctcgtttttcattataaaagctgcacatttacatgattttcgatgcaatttatactgttatttttgtcttattttaacgatttttgtgttttattttttgtatacaacatataaaaaatcccagagtcttttcactgaaaagatcctaggatttcatttttatatcaaagttattcagttttttaagaatgttttctttttatagtctggtttttgctgcttctttttttctttatccaaaatttctaattatttattctttaaacagattctctccatcctgtttgatcacatcttgataccaataaaaactatctttcttatatcgatctaatgtagcgccctcttcttcttcgcgatctacatacacaaatccatatcgtttttgatatccattcagccagcttaacaaatcggtaaaagaccatgtacaatatgcaagcacttcacagccttcctcgatggcttttcctaattcttttaaatgttctcttagataatcaattcgatattcatcatgaatcttatgatcttccgtcttcttatcaaatgctccaagtccattttccgaaatgatgattggcagatcataacgacttgtgatctcacgacaacaatagcgaagcccaactggatcaatactccaatcccagtctgttgtcatcaaatatggattgcctggatttttataaattccaggaactccaagtacctgcgcagaacctttcactcctgttgtattcattgtaccatatggtgttactccatccatcggattatactcgcatacacaactttgataataattaactcccataaaatcaatctctgccgctgctgcctttaaaattttctgatcgtcttttgtaacaactggtgcaaatcctttttttcttaaataattcatggctgctttgggatatcttccatatgcataaacatccatccaccagaaattcttcagctcatcataatcatgttttgacataacattttcaggtttacaatcaagtgcataagatggtgtataagcaaagcttgcaccaatctttcctgttccgcctatctcgcgatatgccaaaacagcctttgcatgtgccataaagacgtgatggttcacttgataaaatgttttctgatcgtcaaactttcctggaggatgctgtgctgtcagccatccaagtgatgtaaaaatattttgttcattaaatgtaatccagtattttaccttacttccatatgccttaaataaagtcttagcataatttacataatcctcaatgatctcctcagattcccatcctccatagagatccactaatgcctgaggaagatcccaatggtagattgtcaccattggttcaatcccatattttaaacattcatcaataatattttcataaaactcaattcctttgggattgacctctcctcttccttccggatagattcttgcccatgaaacagaaaaacgataggtttttaatcccatttccgccatcaacgcgatatcttctttgtagcgatgataatggtcaactgcaacatctccggttgtcgctttatatgtttttcctggaatccttacaaattgatcccagtttgtgattccttttccatcttctctccagccgccttcaatctgataggcagctgaagcacttccccacaaaaatccttctggaaattttgtaactttcatttcttccataaatgttactcttcctttctgctactgtacacttaataatttactttcctttgttactactttatcttcacatgctttaacttttgcaaattgttctgtattggaaataatgatcggtgttgttacatcgtatccatctgctttaatcttgtcaatatcaaattctagtaagatatccccttttttcattgtatctccagattttttctttggagtaaaatattttccttttaaatttactgtatcgattcctacatgtaccaaaagttctactccatcttcacttactaatcctaatgcatgtcctgtttcaaaaacagcatctacttttccgtcaaatggtgcatagacaactcctttttcaggaatgatcgctgctccttttcctaagatttcttgcgaaaatgttggatctttcacttctgttaaaggaatcactttcccttcaagtggacttgtaatgctgatctcattatctaataactgtgcattagattcttctacaaaatctaaatcatcatcttcatctacaatatcttcaaagccaataatcagtgttgcaacaaatgtaacaactactgtgaccaaaattgtgagtgctgcaaataataatgtctgtggttttcctttttctacatactgaacaatcgttacgattgctggtgttgcaattccaaaacatttcatttggaaaaatccaccgactaatccaccaacagcaccaccaatacatgctcctaacattggtcgttttaaacgaagtgttacaccataaagtgcaggttctgtgataccagcaaataatgctgaaaacgcagaagatcctgcgatctgtttaaagtctttgtttttgcttcgaagtgcaactgcaagggaggctgcaccctgtgccatattagaacataattctccgatacagataaagttctcatatcctgttgttgcgatcatccctaatttaatcggtgtaaatgcatgatgcatacctgccataacaacgaatggataaacgccagccacaagaccaatggcaataaatcctaatttatcatgaattgcataaactactgttgataatccattaccgcaaatagctcctaaaggtccaagaatgatcaatgcgatcggtgcttcaattaaaacaactaacattggttttaagaagttctttgtgacaactggcgtgattttatctacaaaacgttctacatatcttagagaatatactgccaaaatgattgggataaccgaataagaataagatgcataagttaccggaatatatttcaaaaatttcacagtctgtcctgcatcatgtgctgtattcatcagtgtgatcaagtttggatgtaacatgatcagtgcaatacttgctgcataatacatatttgttccaaactttttggatgctgaaattgcaatcagtactggcatgaagaaaaacgcaccatctcctataacacttaataactgatatgtttgcccatttgtgcttaacacaccgatcataggaagtaatgtaagcaatactttgatcatagctgcaccaatgattgctggaataacaggtgccatgatacctgaaatcgtatccatcagcattgtaaagatatttttcttttcattcgattttgctggtacttcttttacttcattagaaaaattcccaagtttatttaattcgttaaatacgtttccaacatcatttccaataatgatctgatattgtccaccctttttcatgattcccataacaccttttgttttctttactgcttcatcatcaacgatggattcatcttttaatgtgaaacgaagtcttgtcatacaatgtaccagattgatgacattatcttttcctccaactctttgaaggatcttttttgctgtattttcataatccattttgttttcctcctttttttctggatctaaaaattttcatttttctttatataacaaagacctgacaatagataaaataattcccggggttatttcatctattgtcaggtcttgcttaacttaataataacaaacctatgattattttgtttgttcatctaaaattcgtttgatatgaattaataaatataattgttcatcaattgttaatttatagttatattgctttttaatatattctgcaattttttttactcctgaaaaagcattttcattctgttctaccatcactttataaatttcttgcatcgtatcttcatattccatatggtcaaagactcttgccgcaaaaaactttaaatgtgttaaaaatctctcatacgaaatagattcttcatttaaatctatcttaaaatgaatccttacaatctgtaagactgtattgatcaactctgtaatctgattcacatcggttatattctgtgcatttaattctgcagacacgatatgcattgcaataaatgcagcttcatcatctcccaaatcctctcctgtctgttctttaatccattcaatcgcatgcataccaacctgatattcctttggataaaacttacgaatatcgattttcatcatattctttaatgcgattccttctcgataacgagcgactgctgaattgatatgatccgtcaatgtcacatataaggaatctcttatttctaatttttctttttttgcctcttttactacacgatccacaattccaaggtattcttccgaaatctcttttactacttcctgtagtctcttgctttcttctttattctctagatgatatgtcttatctaccagagactgatcaatattttcaccttttctttttttaaatccaattcccggacctgtcatgatcaattccattccttgtgaatctacactgacaacagcatttgtattcagaactctgattattttcacgttcatcctctcctctaattttatctaagtttttcatcatttttgtatctctataaatgtacaagaaagaatcctgctttacaggattccccgcctgtggcgggtcgcttctgcgacatattacccttccgccgcagtgcgatcctgcccggagggctttttcatatcataagggattccatcggaatttcctatgatataaaaaaagactgcttaagacatacttctcttcctatgtcataaacagtcttgcttaccattacgtaataacaaacttactgctattataatatcaggtaactttttatttgtccattgttttttctattttcgtcatttattctaatttcacaaactttttttgtgcattatgacgaatctatgaatttttatgtatttttcataatttttacattttatttttaattctaatccgcaatcttatcgatcgcatttgtcacagcatctatgtttttgtgaccatctaacatcttttgtttataatctggttcttcctgcttctcttctttcacactgatttcccagaatggtccccctgcattagcaccttctttgccttgtcggatcactttcttaagcgaccacgtctcagctgttctggctctgcttcctacatcggcaatctttactttatctttgccgaccattcttgttaatacaacaaaatgtccattctttgtgaaatctccaggccccatcagtgccacgactggatgtcctgctcttaatgctttctctacagcatctttatccattccgagacctttacactgcattccgtataatttggataatcctggaactacgctgtgagaacatccctgtcctgtgtaataccatccatgtttatatgcctgtttgcacatctttggaacatcagctttctttccagttaaagaactgtagcatacagcaactgcggttggtccgcatcctgctgcctgaatcgtacttccgccgatcttctttcccggataatctgcctgattataataaacaacttttaattgcttgttctctgtctgctctgcagccataacccctgctgtctgtgtcatcatcattgttgcgatccccatcgttgcgatcactctgccagtcatcttgttcaatctcatagtaccctccagataacttctgcttttgacataatacatcagttattaattataacagagggtagtttgttaatcaagtgtttcaattgttaaatttttattaaatctcatttacattttttcatttttttgccaaaagatgataaatgtcgctgcatttattcatgaatttttcgctgtgtcgttcctgcaattccaagctgtgcacgatattttgctacggttcttcttgaaatcttcatattcttttgttctaacaaacttacgatcttactgtcacttaatggttttttcttatcttcttctttcacaagccgtctgatttcttccttaatctcttctgtcgtcgaatcttggtctccaaatgtctgggacgatatactgatcggttccccctgtatatccacttaacggtcttggatttaattcttgaattttaaaaatatactttcttacctgtgatgtcttaatatcaagtgctcttgaaacagtcgataaatgtcccattgcgatatcttccaggtttttctacgatatatcgcaggtcatcatttaatattccttctctttcaagctgaagaaggagacattccgatacactttctgcaaatacacctgctggttctaattgcttgagatgatctaaaagcctttcacaatctttttcttcaattccaagcttgtgactgatctctttttctaagttatcttatatctattttcccgctttctcttcttctatggtcttctgaaattctttcacatcttttgcgatctcaccgcttaataacagcatacagatcagatttgggatcgccatcaatgcatttgcaatatctgagaagttccatacaagctccaatgtctgtgttgccccgacataagctaccagagaaaagataattcggtagatcatgttgaacttatgagttcccatcagatactcaaacgccttttctccatgatactcccatccaagaattgtggaaaatgcaaaaagtgcaattccgatcgttaccagatatcctccaacttttccaagaactgtggaaaatgccgcaatcgttaatgcagaacctatgtacatctctcctgttgccggatcgatctgtccgagcactccggagcttgcgatcgcaagacctgtgatcgtacagacaacgatcgtatcccagaaagttcctgtcatattgatatatgcctgccgaaccggatgatctgttgttgctgctgccgctgtaatcgctgcagatcccattcccgcttcatttgaaaaacatcctctggcaactccgtaacgtgctgcattcatcatagatgcgacgatatttccacaaagagccccaccaaccgctttcacactaaatgccatatgaaagatcatagaaagtcctgctggaagattactgatattcccaagaatgacgatgactcctgcgatcacataaaagattgccatcactggaactacgacagaagatacttttgatatcgtttttattccaccgatgatgatcagtaaggctaaaatagtgatcactgctccaacagtactaaccgatactccaaatgtctcatgaactgctgttgaaattgaatttccctgtgtcatatttccaattccaaaggatgcgatcacggcaaataaagcaaacagccatccaagtacggctccaagctttttgttcttgagtgcctttttcattgtatacattggtccaccggacatctcgcccttttcattgacttctctgtatttgattgccaacatacattctgaaaatttagatgataatccaaaacatgcagaaatccacatccacaccaatgctccagcacctcctgaaaccattgctgtcgctactcctacgatatttccagttccgatcgttgccgccagtgctgttgtcaatgctgaaaatggtgatacatcaccctctcctctgttttttgttctggattctttacttaatgtctttataatcgcccaaggaaggtttctccaggttaggaaattgcatcgaattgttaaaaggattcctgttcccacgagaagcactagcatcactggtccccatacaaaagcatccacatcagatatgatcttacttaacatatactatctctcctctctgatcttattttcatttctaaaatgcaaaaaaggagcaacgaaaattcgttgctccttcaacttatgaacttagtatagccatatatgaccactctgtcaatatttattttaaggtcataccaatgctttcccgatcatctcaccctgcctgatctttgtctcacactggttcttggtacgttctaacagttcttctctgatctcaaccttatccttttctaataataaaatgatcgttgaacctccaaactgaaaatatcctttctcaatcccgcgcctcatagatccggctccatcgtgattaacaatctttccaaccatcaatgctccaacttccatctggagtgcatctccaaagtgttttgtcttcatcaatgtatattctctggtattctctttatagattttcacatgatcatttgcgatcggattgacggtatgataaactccatcaatcctatgattctcactcttaattccatcatcaaaatagcagtatctatgataatcatctactgtcaggcgtaagatcacggcataaccgccctgaaaatgtcttgcgatcttgcggtttctgatcaatgaatccaaggtatatcttgtatcctttacaacaaaagatgtcctctcttcgatcggatacacacttaccttacagtcgcaaggacttcctaagattgttttatcttccggaaatggacgttttccttctttgatctttcttgagaagaattcattataagatttgtaatttttcttctcatattcactcatatcaatatgattattcttgacaaatcctttgatcaggcatttggagatgggagaacttaagaaagctccccctagtttggatacccaaggtctgattaatatttttagactggctcgtcctgccatagttgtatacatccaatgaagcaaacgatcttgcccattctcttcttcgtaaatattcccatctctatcggcatatctcatctacgattctcctatcatcttacagtaagaacatctttactgcgatcaatgctccaataactacaaatgcaagcatacatttcttatctggtttaaagactttaaaatcaaatacaaataagaaagcgatcactgctaacattgcaacatatatgtatggaaattcttctggaaagaatcttcgaagctgatatacgatcggaatgatcagtgcaaccgatgtaattggcagtccctgataatgttttcttctggaactgctgtgtgcctgacgctgttcttctgtaacattaaaatatgccagacgaataactccgcctaaaacataacacatataaatgatccttgcataccattggtccattccaaggcagtaaccgatcacaaccggatacactccaaaacagacaagatcacataaagaatcaatctcgattccaaacttcttggcgtcttcacttctcttgatcatctttgcgatcgttccatcatacatatctgttaatcctgagatcatcaaacataaaattgcgatcttaaagtttccattgaatgcctgtgacattccaaatactgcactgacaactcctaaatatgtcagtattacagatgcattataaaatcctatcatacctttttccctctattctttacgctttatcgtaacatgtgcgactcctgtcatcactgcactgatcaataccagtgcataataactgattcctcggcttaacagcattgccggatataataatccgccaacaaaaatcttcttaaagatatttaaaaataagccttcactgattcccattccgcctggcaacggaagcatatccacagaaattgaaataacactctgtaaagcaactacatcaataaatcctaatgcagaaagtcccattgctctgtatacaagatatgtaattgaaaaatggatcagtctctgaatcaatgtgacaacgaacatccgaaaaataaaaatccgatgtccttgaatgattgctgctgctttatgatactcgatcatagaattctgaagtttttcaagacgttcttcttttttctttaaaatatggaacttttctaatttctgaaacagccacagcacgattttggatgctaacgttggctcaaatacaagaatcagcatgaacgcaacacaaaacacattcaatgccattccaaggtaaaagaagaatgctgccttcccaatatattctgccacaagaaaatgacggaataaaaagatcagtgctcctaaaaataccagaacaaatttatataaaatggtaacgatcatcaaaatgacggttcccacggatatgtcaactttatcgcggttcatgtagtaaagctgcattggctgtccgccagttgcagacggtgtaatacaactgaaaaagaaacctacaaacgaatatttgacgcaatttctcttcggcacatcattgtaatgaagtagccgtagcatgcgataaataatatacgactcgcagcacacaaacacaacgatcataaccaatcccgcaatataatatgcaggttttactgattttagaacttccgccagctcagaaagttcctttcctttcaatacggcatatgcagtcaatccaaataatgcaaagaaaaagactgtattaccgatgacttttttcttattcttcatctttcctaccctttgatctccgataatttccctttgtatttcacagatcttctctctaaaccaactcgttggttgatcttctcaaacaccttccagagtccttgatacaaattggtctttcttccgatcagataacagacttcacttaaaatgatcccgccaaacacatctatgatataatgctgcttggttacctgcgtggaaatacagactaaaattgcaaaaacaagtgaaaatctctgataccacactggaatcttcttctgatgcctgatcccaatataacaaaaccagcttaccaaacagtgaatcgatggaaataagtttgccgattgatcgatcgaatacacaaatcgtaatgcctgatcccaaaatcctgttcctgtgatttctggtcttaccagtgttgttggcaaaaagacaaagaaaatcccacatacgatccttgacagataatctgctgtcaaaaatctatacatatgttctctactgattctcgcagtcataatgtagttcacaacccaaaacacataacatatcaaataaatacttgtaaattctgggatcaccggtaccatccggtcaaatgctgttgtaaaatcatgatgatataatcctttacaaagcaccattgttccactgtaaaccaacgtattcagtactaacgctgtaatcagcggaatgatagaatacttcggaatccatctcagaacataatcttttttctgattcatatgtctgctccttccaatgatctatcctctttcttttctctcttatggttcttccatatatcaaagaatcatgtcaattctgacatgattcttgtactattatatcttttctctttttaaaagtaaaggaaagcggtcatatttaatagttttgtaagatttactctgctttcttttttcttctattgaagagtccataaatacatggaaccactaataatgttagtaaagttccataaatcaaaccaccgatcgtaacaatcgccatcggctgcatcatctcggcaccttgccctaaaccaatcgccattgtagataatccaaggatcgttgtaagggctgtcatcaagatcgggcgtacacgcatcgtacctgctgtcaggattgcttcttcaaattcgtatcccgattctcttaactgattgatcgtatctaccagcacaataccattatttacaatgatacctgcaagcataacaaatccgatcattgcgatcgcacttaagtcttttccagtgatcagcagtcctaagaatcctcctgtaaatgccattggaatcgtaaataaaatgataaatggcgatttcagtgactggaactgtgctaccatgatcaaatacataaatgctactgccagcaataacatcaggccaatctgtcctgttgtttcctgaatggattccatctcacctttcattgtaatactgtatccttttggtgcattgtatttcttaatcttcttttgtacagcgctgctgacttttcctacattgtagccatctttgatctctgatgttacactcaatgttctttcctgctggtttctattaatagaagataaactgtcactatttctgaagttcgctacctgatccaatgtaacttctttttcttttccacttactgttcctgtaagtttcactttcttaagatcatctcttgtcagtgtattctttgcactatttccaacattgacactatactctttttcattgatcgtgatcgttgttgcttcactggcatcttttaatttctcacttaactgttgatagatcgttgcaactgttaaaccattttttactgcctttttcttgtctaccacaacataaagatctggtgttgtctcttcacttccattcgagatgttctgtgttcctttcgtatcctctacaatctgggcaatatcttttccaatagatcttagtttatttaaatcatttcccttgatctgtacggaaataccgcttccaccaagtgcactcatatccatactggattcctgcacttcaacctcacaatcaaatttctttgttttctttaggatttctttcttgatctctttgtttgtatgtttcttcttttcttttaataaaacatacatactggattggtcttcatttgaagatcctcctgatgtcattgaagagattccggaagagccagaggatatcattcctgctatactatcaacatctttgatctcttttactttcttcattactgtatctgtcattgatgctgtttcttccattgaagatccctttggcattttgatcgtcatcgtcatctgtgtgctgtccatgcttggcattaaagagcttccaatattcattgctccaaaaatacttcccacaaacagtgcaagtgttacagctaccacaataatcttacgatttaacaaccgtgtcataactttacggtataatatctgcagtttattgatcactttactatctttttgtgtgactttgttgagtactccagctgacatcattggcacaaatgtcaccgctacgatcaggctggctaccagagagtaaccgatggttagtcccatatccacaaagagctgttttgtaagccctgtcgtgaatacgatcggcaggaatacagaaattgttgttagtgtcgaagatgtgatcgctcctgcaacccctcttgctcctgtgatcgctgcttctttaaccggaactccttcttttcttaatcgatagatattctcaataactacgatcgagttgtccacaagcattcccactccaagtgcgagtcccgacaaggagattacatttagcgtaattcctgtaaagtacatcaacaccaccgcaaaaatgacacttaatggaatggagcatgcaataacgatcgtcggtctgacgtctttcaaaaataataataggataaagactgcaaggattgctcccattaacagattctggatgacagaacctgtcaccatatcaatgtatacaccctgatccataatattaacataatggaatcctttattttctttggtaagtgtcttcatcttcgctgcaactttgtctgctacatcagctgtagaataattattctgtttctgaactgttaatacaacaccgttatttccattcacacgacaatatgtatctgctgagttatctacaatcgctacgtctgctacatcacaaagtttgaccggtgggattcctttgattccaagatctaataattccatattggcaagatctttttgattcgtcaccttatctccaacacgtaccagatactgtgtattcccttcactgatatatcctgccggcatctcaaagttctgtgctgttaacagtgctttgacattcgcaactgtcagcttattcttaatatttgcagcttcttttgcctgctctttgctggaatcaagttgctgctggctggaattcaactgtgcttctccctgtgccagtttgatctccccatcattcatcttctgggttgccgttgctgattgtacattaaactgtgtcagtttagaattgatcgttttctttccttttttgatctgttttaatgcattgtttaatgtttttaaattcttatccaatgctttgatcgaactttttgctgttgtctcctgctttttcagttcttcgatctgagccgcaagctgcatctttgttgctgcatccggaacttgttttgcctgttcttccatcttggcgatctgtgtttttaatgtcttgagggatgtctgcaacgattgtttctgcaccttcaaattcgtgattgaactcgttacctgcacctctttctgagcaagacttaactgtccatccgtaagtgcagtctgagctttcgcaagctgagtattagcctttgttctctgtgcatctaatgtgttctttccagattccatctgggctcttgcctgatcaatcttattttgagcttcatcaaactgaccattcaatgccttctcgatcttctcatttaatttattgatcttcttctcgctgatgatcgcattgatctgttctgttacaagtcctgtactacttacagatgcgactccgtcaacagcttctaaagatggtgcaatcttatcattgatcaactctgataattccgtattacttaacttatcagaatccatcgctgttaccataaccggcatcatatctggatttaatttcacgatcgttggattgcctacttcgtctggccagtagcctttgatcatgtcaagcttctctctcatatcaagagatactgcattcatatccgtgtcaccttcaaattccaaaatgaccattgacatattctcactggaaattgaattaacttctttgatatttgaaatcgttgccattgattgttccactggttttgtaactgtcgtttccacagtctccggagatgctccctgatatgtcgtcataacgattgcatatggcagttccatacttggaagcaagtctgttgtcatctttgtaaatgacacgattcctaaaatgataactagtacaaccgctacaatgactgtatacggtttctttacgctgaattttgagatcattttcttacctttctcatatttcttttcttattccttatttgtctcttttgattactattttgataaccaaagtaatttaatgatattcctgtttcttaaagaagtcaatcacttttattgataattgtcaattaatgtatcggattgtgaactttttttcacacaacaaaaagaaaccagaatacatcttcttatgtactctggcttctgtatattcttgatctcttattctacactgtagtttggtgcttcttttgtgatatggatgtcatgtggatgactttcttttaaggatgcagcagaaatcttaacaaattctcctgtctcctgtaatgtcttgatatcttttgctccacaatatcccattccagaacgaagaccacccatcatctggaagattgtgtcttcaacagttcctttatatgcaacacgtccttcgacaccttctggaactaacttcttagcgtttgtctggaagtaacggtctttactaccattctccatagctgctaaagatcccattccacgatatactttgtattttcttccctggtataattcaaagtctccagggctttcgtcacatcctgcaagcatacttcctaacatacatacatcagctccagctgcgatcgcttttgtaagttctcctgaatatttgataccaccatcggcaataattggaattcctgctttcttagcttcttcatatgcactcatgattgctgtgatctgtggtacaccgataccagctacgacacgagttgtacagatagatccaggtccgataccgatcttcacacagtcagctcctgcttcgatcagtgcttttgctcctgctcctgttgcaacgttacctgcgatcacctgaagatctgggaatttgtctttgaccattcttacgactcttaatacgtttgcagaatgtccatgtgctgagtcaacaacgataacgtcaacatgagcattcactaatgcctgcacacgatctaaaacgtctgctgtgataccaacaccagctccacataataatcttccctgatcatctttcgctgcatttggatatttgatctgtttctcaatatctttgatcgtgatcaatccttttaaattaaagtcatcatcaacgattggtaatttttcttttcttgcttttcctaaaatctgctttgcttcttctaatgtaattccttctttagctgttactagtccttcagaagtcatagattctttgatcttcttagagaaatctgtctcaaactttaagtcacggtttgtgataataccaacaagctttgtaccttctgtaattggtacaccggaaatacgatacttcgccattaagtcgtcagcatcctgaatggtatgttctggtgataatgaaaatggatctgtgataaccccgttttcagaacgttttaccttatccacttcttctgcctgttcttcaattgacatgttcttatgtataataccaattccaccctgtcttgccattgcgattgccatgcggtgttctgtaacagtatccatgctggcactcatcaatggaatatttaactgaatcttgtttgtcaatcgtgtacgtgtatccacatcattcgcaatcacttctgaaaatgctggtactaataaaacatcatcaaatgtaattccttcaccaattaacttacccattttcttgttttcctcgctttcttgtattttaatatctgatttgtattgttagatatgttaacaaatagtttctttgatgtcaacagattattttatactttttttaaaacgtatggattattttctgtacatgtatggaattatctgaatattctaaatatagcaatccacactttacatctttttaagtacaagaaaaggaattactgctttcacaataactccttttctataatcttgatatcaatccgcttgatatctcttgtaatctctactcttctacgatagaaattttacttccaatcgcaagttttggcattggctttgcctcaacacaaatacttccaggaagacctgcttctttcgctccactgaagacaacggttaaatgtcccagtgtctccaaattagactgggcaatatctcctacggcagtgatgagatattctttctgatccacaaccagtttatctccttttttgattgttccgtctaccttcttctgatcgatgaaatgacagaaatcttttaatgtatctggtacattgtctccgaataatacaaacataccttcctcaaaaaaagcatctacctgttctcccagttcgataatctcagtctgaaatattgcttttcccatttggaatcctccttttatttaccctgtaatttctgatcgattgctgctgctgctttctttcctgctcccatggcaaggataactgttgctgctccagttactgtatctccacctgcgtacacaccatctttgcttgtctccattgtctcttcgttgacaatgattccaccccacttctgagtgtcaagtcctggtgttgtgtgacggatcagtgggttagggctctgtccgatcgcaatgatgactgtatcaacatcaagatcatagttagatccttcgattggctgtggagaacgtcttccagatgcatctggttcacccagttcctgtttaatgacctccatgctgcttacccatccgttttcatctgctttaatcgcagctgggttatttaagaatttgaagataattccttcttcttttgcgtgatgtaattcttctaaacgtgctggtgcttcttcctcgctacgacggtatacgatataaacttcttctgcacctaatcgttttgctgttctggcagcatccattgctacgttaccagcacctacgactgctactttcttaccaactttgactggagttgggcactctgggaatttgtatcccttcatcaagtttacacgagtcaagaattcatttgcagaatatactcctaagtggttttctccaggaatatttaaaaatcttggaagtcctgctccacttcctacgaagactgctttgtatccatcttccattaattcatcaattgtgatagaacgtccaacgataacgtttgtctcaatatctacacctaacttctgaacgctttcgatctcttttgctaccagatcttttggcagacggaattctggaataccataacttaatactccacctggtttatgtaatgcttcaaagactgttacatcataacctttcttgatcagttctccggcacatgtgataccagcaggtccacatccgacaactgctactttcattccgttcttctcaatattaacttctgtttctttggcgtttgccatatgccagtctgcgacgaaacgttccatacgtccaataccaacaggctctcccttgataccacggacacattttccttcacactggttctcctgtggacatactcgtccgcagattgcaggtaatgcattctctgttgtgatcacttcgtatgcaccttcaaaatctcctgctgctactttctcgataaatgctggaattggtacgttaaccggacatcctccaacacaaggtttattcttacagtttaagcaacgagctgcttcttccattgccatctcttttgtatatccaagagcaacttcttcaaagttcttattacggacatttgggtcctgttctggcatagctaccttcttaagactcatatttgccatcgtttacatcccccttccaattctacattcatgttcttcttctctgaacataccctgacgctgcatacattcgtcaaagtttactttaaatccatcaaaatctggtccgtcaacacatgcgaattttgtttctccaccgatgttgacacggcatccaccgcacattcctgttccgtcgatcatgattggatttaaagataccatagttgggatgtcatattcttttgtgatcttaaccacattcttcatcatgataagtggcccgattgcgataacttcatcgtattttactccagctttgatctggtcttctaatactgttgtaacgaaacctttggttccaagacttccgtcatctgttgcaatatatacattatcgcagaattcttcgaataattccttaagaataacaaattctgcactcttaccaccaatgatcacatcaactggtactcccatcttcgctaacttacgaagctgtggatataatggggctgcacctacaccaccggctacaccgatgacacggtcacacttgtgcaaaggagctggctgacctaatggtcccacgaaatcctgtacataatctccttctgctttcttgcttaacaattctgttgtatatcctacaacctgataaatgatcgttactgtctctttctcacgatcataatctgcgatcgttaaaggaactctttctccatcttcatctactcggataatgatgaactgtcccggttcacattttcttgccacataaggagcatgaatctccattaactcaactgcctggttaagtgtctgcttcttgacaatcttatacaccacgtacacctctttcttaaaatatcttctttttattatacatggaatctgcacaataagaaagtgtttttttatttattttttgtcgacaataaaattatataaaattttatttcgtattgcaatatttaatgaaattttattttatattttgttattttttatgtaaaaagcagcataactgctttctttgctgccatgctgcttactttctacattattatagagctgcttcgtaaatacttacaatatcttccttactcaatggtacaaaagatcccttgcatccatcggccgctttctgtgccataatgtcaaaatattctttatcaattccaacatctgttaacgtctgtggaagtcccatcttcttaaagtattctcttgtacatgcaattccttctttggctgctgccatatcatcgtcatttacaacatcccagacatttcttgcatagtctgcaaatttatatgctgtatcatcattcagtgcaaattccatccagtgaggtgttaagattgctaatccttctccatgtgtgatatcatagaatgcgcttaattcatgttccattggatgtacacaccatgcgacttcagctccatattgaatcattccgttaattgccatacttgctgtccacatcagattagctcttgcatcataattgtctggttcttctaaagcaacaggaccatatttaaaacagttctttaacagtccttccgcaaatcttgcttgaacgtctgcattcttcacattggtaaagtaattctcgcaaatatgactgatgatatctgctgttccagccgctgtctgtttttttgatacagaataggtatattccggatcaaggattgacatctttggtttcatatgatcacttgcagttccccatttttcattctttgacatatcggagataaccgcaaatttatccatctctgatcctgtggctgataatgtcaggacactgtaaattggcaatgctttcttgatccatcttggtgtaataaccagatcccatggatccccatcatagcaagctcctgccgctacaacctttgcacagtcaatgacagatcctcctccaatagcaagtaccatatcgatgctgttttctttacaaagttttacaccttctctaacagattcaatctttggatttggtgcgattcctgataattcaaagatttccatatcttcttcttttaaaatcttgactgcttcgtcataaattcctgcttttttgatacttccaccgccatagcatagtaaaactttgttaccgctctctgaaagttcactaagatgagaaatctgtccttttccaaaatgaatctttgttggaatagaatacgtaaaattgttcatggctacctcctgtttttaatgtttcatttattcttcgtctaacatgacactgaccctgtacattccaggtttgcttgcctcttcataagcttcttgcagtctgcttagtggaaatttcttctcttctaccaatttagacacatccacaaccttggtacttaatgcttgggcagcttctttgaagtcttcatgatctgccccgaatgtcccgatcagttccatctttctatagtgtaacatatttgagtcaactttcaactctggaactggatatcctgccgcaaataataacattcttccatcattttgttttaacatctcaagtccctgactgttggcactggttgatccaacagctacgatcacagcatctgctccaattccttccgttaactcttttaccttttctacaggatcactttcattacagtctatcacttcaaatcccatcgctttggctgtctcaatcttcttaggaatcatctctgatacgatcacacgacatccgtaagctttcgctgtctgggcgttaattaatcccatagttcctgcaccaatgactacaactgtttcaaatggctttaatcttaatttgtcggtttgtattccttttgggcatagtctttgttcttatgacaaacttacatttcatgatctgaatggttataattggtgaaatcttcgactttgttttgtttttctacgaattatgcttcttatccggatgagattttaaatgatcggaagaggattccgatcgtggatgattgtgcgaatgtggaatattgggtggtttggaagaaagggaatacgtatcgattttagttttttatggagaaaaaaaatcctgcagaaattcattcgaatttctgtaggatttttgatatttagtctttgagtcgcttcgctccctgtagacgcccactcaactaagctcatctttcgcctgtggctcggattcgctaaggttcgggacggactttcgcactaagttcaagctgcgcctttggcttgctttctctaagtactcaatgtctctacatcattcccattccggctggtgctcctgctggcattgctggtgcttcttctttgatattcgcaacaactgattctgttgttaataatgtagaagctacggatgttgcattctgtaatgcgcttcttgttactttggctggatcgatgattcctttttctaccatgtctacgtattctccatgtaatgcatcgaatccttttccgatttctgcttcttttactttgttgacaataacagctccttcaagacctgcattgactgcgatctggaataatggtgcttctaatgctttgaggatgatgtttgctcctgttttctcgtctccttctaagtctgctactttctcagctgctttcttagatacatgaatataagcagatcctccaccgaagatgattccctcttctacagcggcttttgttgctgctaaggcatcttccagacgtaatttgctttctttcatctctgtttctgttgctgctccaacacggatcactgcaactccaccagataatttagctaatctttcctgtaatttttctttgtcgaattcagatgttgtttcttcgatctgtgctttgatctgtccaagacgtgcctggattgcatctttatctccttcaccatctacgatgaccgtgttttctttttcaactttgacagattttgcacgtcctaactgatctaatgttgcgtcttttaattccagaccaacttcttcagagatcactgtaccacctgttaagatagcgatatcttcaagcattgcttttcttctgtctccatatccaggtgctttcactgcacatacagagaatgttccacgtaatttgttaacgatcagtgttgttaatgcttcaccttcgatatcttcagcaatgatcagtaatttcttaccactctgtacaatctgctctaataatggaaggatttcctgaatattagtgatcttcttgtctgtgatcagaatatatggatcatctaattcagcaaccattttttccatatctgttgagaaatatgctgataaatatccacgatcaaactgcattccttctactaaatctaattctgttttcattgttttagattcttcgatcgtgataactccgtcgttagataccttttccatagcatctgctactaattctccaacttcttcgtctgctgcagagattgctgctactttcgcaatctgatctcttcctgtaactttgctactcatctcggcaattgcttcaacagctgcttctgtcgctttcttcattcctttacgaagaatgattgggtttgctcctgctgctaagtttttcattccttcgttgatcattgcctgtgcaagaactgtagctgttgttgtaccatctccggcaacatcatttgtcttagttgctacttctttgactacctgagctcccatattctcaaatgggtcttctaattcaatttcttttgcgatcgttacaccgtcatttgtgatcagcggtgcaccaaaagatttgtctaatacaacattgcgtcctttgggtccgattgtaactcttactgtatctgctaactggttaactcctgcttccagtgcttttcttgcttcaattccgtatttaatctcttttgccatgatcttaattacctccgactaattccttgattaaatcaaataattgtgtgatgtgataaaactattctacaactgctaaaatatcattctgttttacgatgataaattcttcatcttctaattttacttctgttcctgcatatttagaataaataactttctgtcctacagaaacttccatcttcacatcttctgttccaggtccgactgcaacaacttctgcttcctgtggtttttcctgtgttgctgttgtaaggacgattcctgacttagttgttgtttctgcttccagctgttttaatacaactctatctcctaatggtgttaacttcataatgatattacctcctaaatatattagaattattgttctttttatcttttgttagcactcacttatatcgagtgctaactctatgttcattagtataacaccagacaaaaaaaatgcaaccccctttttataaaaattctataaactgagattgcattctttggtattttacttattctttgatgtatttttttgcttcttctgaacttcttgttggaactgtctggaaatatacatgtacatgttttttgatcagttcatgaatagcttccatctccatggtatcacacgcaactcttcttgcaactgctttacgttctccacgaattcccatacctccgatattaagttgattgatcttgatccctcgtttgatcaattcttcaaataccagtggggattctgcaattacgatcacccgctctccatcaaaggatggggcttcttttaatttctccgttgcacgatcgatcccatatacatgaattataaggccttggggcgccatctctttgatcactttgcttcggaatttatccttcgccacaacatcatctacaataatgatcctgttcgctctgacttccggcacccataatgtcaaaatctccgtatgtatgagcctgtcatcaactctcgctaatacaatgtttttcattcttctacctccttatataattcacgcacatctttcactgtctctggcgctgccttaagaagatctttgcacacctcttgtgcactcttttccgcgtaacatcccataactacttccatcatcaacggaagattgattccagttacgtggtagagatcgtattctgacattaaagaaattaccgtattaaacggacttccataaaacagatctgttaatataaggacttcttctccttctgatgtctgttcaatactctctctgatcttctctctcaaagtatccactgattcttctggttcaagcccaaatgcctcaaggtcttcctgttcccctgcgatcatctgtgctgtatccacaagtcctcttgcataacttccatgagataccacgattaccttcatcaattttcctctcttctctctcatcacatcttgcctgttacggcaaatttgattaatttggtttgtaagaactctttaagcttacaattctattaaataccatgtgttcttttgtagaatctttggaatctaaacagaaatatcctgttctcataaactggaaactgtcttccttatcatatttctctaactcaggctctacatatgcttccttgatcacagtcagtgaatttggattcacattaatacttccatcttcattatatacacctttttcttcatctacaatgttttcatacagacgaatttctgcttttttcgcagttggtacagatacccaatggatcgttccgcgaacctttcttccatctggactgtttcctcctctggattctggatcatatgtcgcatatacacaggttacattgccgtcctcatctacatcgtaccctgtacatgtcacaaaatatgcattcatcagacgtacttcattacctacatataaacgacggtatttcttaggcttttcaatcttgaaatcttctcgttcgatatataattctcttgaaaatggtacctgtcttgttcccatctcttcgttttcctgattatttggaacgtcaacgagttccccttctccttctggatagtttgtgatcaccagcttgatcggatctaagatcgctgccatacgtggacgttttaatttcagatcatcacggatgcagtattcaagcatcgctgaatctacagaactgtgactctttgcaactccgacaagttccataaacttcttgatggattctggtgtatatcctcttcttctaagtgctgataatgataccagacgtggatcatcccacccatctacgattccatcttcaactaatttcttgatataacgttttcctgtgacaacatttgtcagatataacttcgcaaactcaatctgttttggcggattctcaaattcacattcattcacaacccagtcatataatggtctgtggtcctcgaattccagtgtacagatagaatgtgtcaccccttcaaatgcatcctctaatggatgtgcaaagtcatacattggatagatacaccatttgtttcctgtattatgatgttccattcttgcgatacgataaagaattggatccctcatgttgatatttccagatgtcatatcgatcttggcacgaagaactttgcttccatctgggtattttccttccttcatctcgcggaataactgtaagttctcttccggtgtacggtcacgatatggactgttctttccaggttctgttaaagtccctcggtattctctgatctgttcagcattcagatcacagacatatgcttttcccttcttgatcaggaattctgcacattcatacatcttgtcaaagtagttagaagcataatagatatgttcgtgataatctgctcctaaccattctacgtcctctttaatagaatttacatattcttccttctcttttgttgggtttgtatcatcaaaacggaaatggaaatctccgccatattcctgagccagtccatagtttaataagatggattttgcgtgtccgatatgaagatatccgtttggttctggtggaaatcttgtaactaccttcttgcaatgcccttcttctatatctttttctatgatctgttcgataaaattcttagaaatcgtttcttccatgtcttcctccatatagttctttctattctgattataatgtatcttctatacacttgcaatcatataatttctgtatcattgtgaaatacagataatccttctatataagatctaatgcctccatgacatttgaaactcctacaagtctcatgtctgtctggaccttgatctgatctacattcgcctgaggcagaatgcatcgtttaaatcctagtttctgtgcttctttgatccttgcttctccacctgatacggctcttacttctcctaccagaccaacttctccaaaaatgatcgtatcttctaagatcggccggttcttataactcgatgcgattgccataataataccaagatcgatcgctggttcgccaagtttcatacctccagccagattcacatacgcatcacagccgccaagctgcagtccaactctcttctcaagcactgccatcaaaagattcaccctgttataatcaattccaaccgctgttcttctcggcatctgaaagcttgttggtgataccaatgcctgaatctcgatcagaatcggtctggttccttccatggaacatacaacaacggatcctgacgcatcaatgggtcttccattaagcatcgtctttgacggattctccacttctacaagtccattgttacacatctcaaacacaccgatctcgttcgtggatccaaaacggtttttgacacctcttaagattctgtatgccgcttctctttccccttcaaaataaaggaccgtatctaccatatgctcaagtgttcttggtcctgcaaccactccttctttggtcacatgtcctacgataaaaactgcgatattattctctttcgcaactctcatcatcgctgcagtcacttctcttacctgagacacactgcctgctgccgaggaaagatcctcgctgtacattgtctgaatcgaatcaatcaccgcaaattctggtttcgtctttaagatcgcattcgtgatcgcatcaagatctgtctcacaatacagaagcatctcttcttcaaatgttccgatcctctctgctctcatcttgatctgatgcatagattcttccccagaaatatacaaaaccttacgtttgctgttcgcaagattcctgcatacctgtaataataacgtggatttcccgattcccggatctcctccgaccaacgatagggaacctttgacaatcccgccgcctaacacacggtccagttcatgaatccctgttggaatccgctcttcattctctactgttacctcggatatattcataggagaggcagaagtctttaaagacttcgcccctccttttttcgtttctgtaactttctcttctgtaaaagtattccactgcttacaggcaggacactgccccatccacttggaagactcatgaccacactggctgcaaaaataaactgtcttttgttttgccattggtgctcctttatgttactactgtttctttacacgaacagctgctgctgttccctcgcttaactcaacactcagagttaattttcctccaagatttgctttcatcattcctacattcgtattatcaataaaaactttatattcctgtccggcttctacttctaaagtaacctggacatcagatgaagattcaatctcaaatgcaactccatctgttgttgcaacaaagttatgtactgctgaacctggaactgattcaaagatcagctgtccgttcttgtccagttttgtcattgtcttgaaagtcttgatcttatagatatctccttcaaactggatatctcctttcttcgctttctgtgctaatgtatagtcaccaaagctaagtgttccattgtcttcgctgcggaataattcagttaccactgccattgtcttttcctcctaatatatgtttcggtcgtcgtatgtatattataatatatttcagtattatttactagttttcctttaccgaaaaagtaagttttttatcttttttaccaatcgtcatcgtctgtccattcgtaagggttccttctaagatcttatctgccagtacatcttcaatctcattctggatgatccttcttaatggtcttgccccataattctcatcatatcccttatctgctaacagatccatcgcaccagatgtgatctttaatgtgatctgatgttcgcttaataaacgggctctcaattcatccataaataattttgcgatcttcttaacttcttcctttgtaaggacggcaaatacgatcgtctcatcaattcgatttaaaaactctgggcgaaagatctgtttcacttcttccataacaccctttttcatacgttcatgagtcttggctttatctgtatcatccatagaaaatcctaaatgttttggtgcaatgatacggtttgcacctgcattggaagtcataatgataacagtattcttaaagtcgacttttcttccattggaatctgtaatatgtccgtcatctaatacctgaagcaggatattaaatacatcaggatgagctttttcgatctcatcaaaaagaaggacagagtaaggatgtcttcgaatctgttcactcagctgtccgccttctccaaatccaacatatcctggaggagatccaatgatctttgatacactgtgcttctccatatattcagacatatccacacggatcagatcttcttctcttccaaataaagcttttgctaatgtctttgacaactctgtcttaccaactcctgttggccctaaaaataagaatgatccgatcggacggtttggactcttaagaccgactctgcttctcttcacagctttggcaactgcattgaccgcttcatcttgcccgatcacatgtttgtgaagttctttctctaaatgtcttaatcgttccatatctccctttgtaagctgtgttactggaatctgtgtccataaagaaacgacttctgcggcatcctctgttgtcaattctggaatctcattttgcttcttctgatttctcttcatcttacgttccagagatttctcaagtttgttcttctctttcttaagctctcttgcttctgtaatatctccatcagaaagcgctgcttcgatcttctctatgatctccctgatctccttgcgttctttcttaaaacctgcatgacttccaagctgttccattcgttttcttgcacaggcttcatctaacagatcgatggctttatctggcagaaaacgatcactgatatatcgatcagaaagagaggcgatcgcctctgccacatcttctgataccaggatcctatgataatcttcaaaacgatgtttgatcccttttaagatcgtgatcgtttcttctacggttggttctttcactctgactggttggaatcttcgaactaatgctgcatctttttcaaaatattttgtatattcttcactcgttgtcgcaccgatcagctgaaaatctcctcttgccaatgctggttttaagatattagatgcatccatagctccctcagaacctccagctccaatgatcgtatgaatctcatcgataaacaaaataatagaatcatcctgtgttgcttcggttacgatgcgtttcattcgttcttcaaattccccacggaatttcgttccagcgatcactttcgtaaggtctaaggacaaaatcctcttattcttaagaattcttggcatattgccttcggcgatcctttgtgcaaggccttcaacaatcgctgttttaccaacccctggatcaccgatcagacatggattattctttgtccttctgcaaaggatctgcatcaggcgttccatctcactttcacgtccgatcatcggatcaagcttcccaagcatggctttctctgtcagatctgtactatactgaagcaacatatattctcctgctccatcttccatatcaccgccatcagagattgcttcattatattcattcttcgcacttctgaaatcaattcctgcagtaactaaaatatctgtatagattccttcggatgaaatcttatgatcttccagaaaacggaatgcttcattatctccatctttgatcatcgccatcaagatatgttctgatccgatcgcttcacacccgtatttcattgcaagttctcctgcaatttctaacaggtattctgtcttcggagtatccattaccgttcttcttcggtcttttggcatctttgacttctctttgatcgcttcttctattaattctcttgtcactccgtgcatcttgagaacttcacttgcaagagatccgtctgccccataaagtcctagcagaacaaaaatactgctgacatctttaaatccaagatatccagcaatctctcgtccttcattcaatgctttggaggcatattttgtaaatggtaatcggttcataattcctcctgttattactttctgtctaatttctggtacatatcatgaatcaaccgattcatctcgtcttctgtaactcctttacagacagcttccgcaactaacatccttaaattctcctgaatgcttgctaattcctgctgtttttccaaagtttcaacacttatgactgcaccttttcttcgatctagtttcaggtatccttcttctcttaagatcgcataggctttgttcaccgtgtgcatattcactccaagcacctgtgctaactgacggacagatggaagtgattctccatcagcaaattctgcacatgcgattcccataatgatctgatttcttaactgtacatagattgcctcgtcactattgaaatcaatctccagtatcattgtgcaacccttctttcctctttcgaaatttacaacttatctatgatattttgttatacatagactataatataaagcacagtctgtcaagagcttctcttccagataataaagaaaaagatgcagtgtaaaaaactacatctctctcgtctatttttcatttagatctaaaattctttgatttgcacttcctcggaattttaatgtgatatctttctgggattcgataaactgtccatcaaccagcgtatcaatataagataacatctcttccgtaaacggtgtgtatactttaccaccttcgagcaaatccttgtcataagtatatcctgtatagcaccagatattcttctttggataattttctttgatctcttttaataatctaaccagttcttcctgattctccggttcaaatggttcccctccaagaagcgaaaaaccttcaatataatctggctttaacaattccatgatataatcttttgtctccgtcgtaaatggctttccataacaaaagtcccatgtctccttattaaagcatcctggacaatgatttcggcagcctgatacgaataagctgactctgactcctggtccattcgcaatatcacattttttaatttctccgtagtgcatatgatctcctctgtcatcgtgttttataaatgaaggactcgatccttgatctcctgtgtacgtccctgattccagaattgtgttccgatatatccacaagtacgtcttgcaacaaacatatgatcctgatctgtatttccacagtttggacattcccagatcagttttcctgattcatcttctttgatctgaatctctccgtcgtatccacaacattcacagtaatcactctttgtatttaactctgcatacatgatgttatcgtaaataaatttcatcacggataagacggctggaatattatcctgcatgtttggtacttcaatgtagctgatcgctccgcctggagataatttctggaattctgactcaaatgccagtttgctgaatgcatcgatctcttctgttacatgaacatgatagctgtttgtgatgtagttcttatctgtaactcccggaatgataccaaaacgtttctgtaagcattttgcaaacttgtaagttgttgattccattggtgttccgtatacagaatagctgatattttctgcttccttccattcgttacatttatcatttaacttctgcataacttttagcgcaaattcttttccttcatcggatgtatgagattttcctgtcatacgaacacacatctcataaagtcctgcatatccaagagaaattgtggagtatccatcatataataacttatcgatcttctcaccttttttaagtcttgccagtgccccatgctgccaaaggatcggtgcaacatcagatactgctccctttaatctctcatggcgacatcttaatgctctgtggcacaattccagtctctcttctaagatgtcccagaatttatccatatctccattagaactgcatgcgacatcaaccaagttgatcgttacaacaccctgattaaatcttccatagaatttatggcttccatctgcatttctctgggaatcttcaaccgttaagaaggatctgcatcccatgcaaggatatacttcaccatttttcagttctctcattactttcgctgagatatagtctggaaccatgcgttttgctgtacattttgcagctaattctgtcagatgccaatacttggaatctggtgtgatgttatcatcatctaatgcataaataagttttgggaaggctggagtgatccagactcctttttcattcttaacaccctgaattctctgtttcaggacttcttcgatcacaagagccagatcgtctcttgtctgtccttctggtacttcgtcaagatacataaagactgtgacaaatggcgcttgtccattacatgtcattaaagttaccagctgatactggatcgtctggattccctgtttgatctcatcatacagacgcatctctgtaatcttgtcgatgatcgcatcatccatagattctccgatcactttacgttccttcacgacattcttacgcagcttctttcgactgatgtctacaaatggtgctaaatgtgctaatgtaaaagactgtcctccatactggttgcttgcaacctgagcaacgatctgtgttgtcacattacatgctgtaaaaaatgaatgtggtttctcgatcaatgtctcactgatcaccgttccattctgaagcatatcttccaagttgatcagatcacagttatgttctctctgtgcaaaatagtcagaatcatgaaaatggatgattccttcttcatgagcacgaatgatctcatttggcagaaggacacgtttacttaagtctttgctgacttctcctgccatataatctctctgcgtggaattgatcactgggttcttattcgaattctcctgatttacttcctcattaatattatcaagtaaagaaagaattccatcatcggtcgtatttgattttcttctcagttctctcttaaaacggtatcttacatacttctgggcaacttcatatcctctcatctccatgatgcctgtctcgaccatattctggatatcttctacattcaccgcatgagaagagtttgctacctgatctgcaaccttctctgcgatcgccatgatctgatactgattcatctgatggatctttgttacctcttcattcgccttcgtgatcgcattgatgatcttatcgagatcaaaggttacctcctcaccgtttctcttgataatctttgtttttacatcaccattcatagtttctccctcatttatataaaattacaagattctgtgtgtttccattttctggcacaaaatcttgttgtcgttctaccaatcagcactatatcttgtgccattgcctttattatattacactctttttcataaaaaagaaagagctaatttttcattttagagaatatgaagatgctcaaacagaatcttaaatcccaaaagtatcagtattatgccacctgcgagctctgccttggatttatattttgttccaaaaatatttccgatctttactcctacaaatgaaatcaagaaagtacagactccaatcatcgacgctgcggatacaatatgcacatttaaaaaggcaaatgtgatcccaactgctaatgcatcgatacttgtcgcaacagcaagcatgaacatttctttcactgcgatcgaatcatctgcctgttcttcatcatttgataatgcttctttgaccatattgattccgatcagcccaagaagcacaaatgcgatccaatggtcgatcgatgtgatctggtctttaaactgtgttccaaggaaaaatccgattgttggcatcagtgcctgaaatcctccaaaccataaaccaacaatgatcccttttttcaaaactttttctctcatcgccagtcctttgcagatagaaacagcaaatgcatccatcgccaatccaacagccagtgttaataacgtaagtaaatccataaaaacgtcctccatatcgtaagtttttcatatcataggggattccatcggaatttcctatgatatgaaaaagacccacagacgaaagccttgttataaacaaaagcttatcgtctgtgagtctcgttaattaagacagcaccagatgtcgttcatcattatgttgatactgtcacagattctctgctaactactccctcacggaaatatctataagatcataccggatgtgcttccggcaaaatgtgcctacgtatcatatctcaactgagaatctttgtcaatatctttcctttaatttttgattacgcttttcaagatctaacaggtattctttcatttccagaccacctgcatatcctgtcagtgaaccgttcattccgatcactctgtgacatggaacaacgatcacgatcggattcctgttattcgccatgccaacagctcgacatccttttggaatccctactgattccgcaatgtctttgtaagtacaagtttccccatatggaatcttctccaatgctttccatactttgatctggaattctgttccatgataagaaatcttcaggtcaaacttctttctccgcccatcaaaatactgtgataattgcagtgctgcttccctgatcaattctgtattcttcttctcgccttctaatgtcttcgtcccaaaatatatcccgcaaatgccatgcccatcttcctcaatcgttaaattaccgattggaaaactataatcataatagtacctcatatgacaatcctcctaaaaataggtataccatattcttccatggttggcaaggactaacttgacatgtacatatttcttgcgtacaatgaaaagaactgtataaaaatgaacagatatttattttaggaggaattttcattggaccccagtatgatattacagataatcgcaattatcattttattaatgctttctgcttatttttcatctgcagaaacagcacttacaaccgtcaatccacatagtatgcgtgccatggcagaagatggcaataaaaaagctgctattgttttaaaattgatcgagaatccaagccagatgctttccagcgtcttagtcggaaataaccttgtgaatatttcattaacatcccttactacaacgatcgctattcgtatctttggaagcatgggagccggaatcgcaactgctgtgatcacagtacttgtattgatctttggtgagatcacaccaaagacttttgcaacgatcaataatacaaaacttgctctaagctatgcttccagcatttatctgatcacaaaattactgacaccggttgtttacattatcaacaaactttctacagcgatccttatcatcttgcggatcgactcgaaacaatccaaacgtatcatgactgaacgtgaacttcgtacgatcgttgatgtcagccacgaagaaggcgttatcgaagaatctgagaaagatatgctaaacaacgtttttgattttaaggaatctcttgccaaggatattatgatcccgcgaatcgatgtaacttttgtgtctgtagatgcttcttatgatgaagttcttgatattttccgcgaggccggttattctagacttcctgtttatgaaggaagtaaagatcatgttgttggtattgtttattttaaggatgtttatttctaccgcagccagcacagaggcgagatctttcatttgaaagatgttctgcgtaagccgttctttacgtatgaaactcagaaagtatcaagccttcttgcacagatgcgtgaaaaatctgttagtttctccattgttttggatgaatatggagtgactgcaggtcttattactctagaagatatcgttgaagagatttttggagaactgcgtgatgaatatgatgattctgaggaagaaactttcaaaaaattatccgatggatcttatatggtatccgcttctttaaagcttgatgatcttgatgatctgcttgacgtagaccttgattctgaggattatgattctcttggcggatatatcatcgaactgcttgatcatctgccttcagagggcgaaactgcagaagatgaacattttctttttaaagttgtttctgttgataagaaccgtatggaaacaattcatatcattccaaaagagcagtaaaaaaagaaccttgcttcttcttgcaaggttctttttttgtactcttatttaaaatattctactccggattcgaagatcttctgatctttctgtccgtaaatattgattcctacatagctgtcacgacgttctgaatgtcccatcttaccaaggactcttccatctggacttgtgataccttcaatcgcatggtaagaaccatttggattgaattcttcattcattgtaggatcaccattgaggtcaacatactgtgttgctacctgtccattttcaaacagtttctggatcacatcttcatctgctacgaatcgtccttctccatgagatactggtatactgaagatatcatctacatgtacattgttaaaccatggtgacagattagaagcgattcttgtataagcaaccttagaaatatgacgaccaatgcggtttgttgtcagtgtaggtgattttgcattctgttctacgatcttaccttctggaacaagtcctaatttgatcagggcctggaatccgttacagataccaagtgccagtccatcacggttatttaacagatccatgactgcttcttttaatttttcatttctaaatgctgttgcaaagaattttgcagatccatctggttcatcaccggcactgaatccacctgggaacatgatgatctgggattctttgatcgctttttcaaaaacttccactgaatcacggattccctgtgcatctaagttcttaaatacctttgtgatcacgttcgctcctgcacgttcaaatgctttcgctgaatcatattcacagtttgttcctgggaatactggaataaatacatttggttttgcaactttattcttgcatacgtaaatatttccttttgtatagtgtcttgttgtatcaacgatgctctgatctccttcagatcttgttgggaatactttctctaatggtttcttccatgtatcaatcgcttcttctaatgttacaacttcgtcaccaaatacaaattcatgtttgtctgtaacctcacctaacattaatcctggaatcgcaagtttatgaacatctcttgtgctcatttcaacaacaaatgatccaaacttaggatctgttaagtcttttaattctacttcttcatcaaagatcacacctaatttattaccaaatgccatcttggcaactgcttctaaggctcctccgccgccaattgcatatgcagatttgataattccatctttgatcagttttgtaatacgttggtatactttcttcacttcagaatatattggaagattgtatgcatctgttgggatacagatacggatcagacggtttcctgctctcttaagttctggtgtgataacatctgttgtcttcgctacatcgactgcaaaagataccagtgttggtggtacatcaatatcattgaatgttccagacatactgtcctttccaccgattgatgcaagtccaaatcccatctgtgcctgatatgcaccaagcagtgctgcaaccggctgtccccagcgtgtcttgtcttctccaagacgtttaaagtattcctggaatgtcaggcggatatttctataatctccaccagaagccacgatcttcgcgatagattctgtgatcgcataaactgctccatggaatggactccatttggacagatatggatcaaatccataactcatcattgtgactgtatcgcattctcctttcaatactggaagttttgcgaccattgtctgaattggtgtcatctggtattttccaccatatggcattgtaactgttgctgctccgatagagctgtcgaatctctctacgagacctttctgtgaacatacattaagatcagataatgtattcttgcacacttcttcaaatgtacctgtctcgtctttgcggttaaagtaagattctacacggtgagggatctctacaaatacttctgtttcctgatgtgctccgtttgtatcaaggaaagctcttgagatattaacgatctcttttcctctccatttcagtactaatcttggatcttctgttacaacagcaacttctacagcctctaagttctcttctgcagagtatgcaaggaactgatctacgtcttttggatctacaacaacagccatacgttcctgagattcagaaatcgctaattctgttccatcaagtcctgcatatttcttaggtactttatcaagatctacaaccagaccatctgcaagttctccgatcgctacggaaactccacctgcaccaaagtcattacatttcttgatcagacggctgacttcttctcttctgaataatctctggatcttacgttctgttggtggattacctttctgaacttcagctccacatgtctcgatagattcttctgtatgaactttagatgatcctgttgctcctccacaaccgtcacgccctgttcttccacctaataagatgatgatatctcctgggtcagagttctctctgatcacgttctttctaggtgctgcacccataacggcaccgatctccatacgttttgcaacatagtctggatgatatacttcattaacatatcctgttgcaagaccgatctggtttccataagaactgtatccattcgcagcttcatttacaatcttatactgtggtaatttaccttttaatgtgtcttttaatgggactgttggatcagcagcacctgtaacacgcattgcctgatatacataagaacgtcctgataatgggtcacggatcgctcctccaagacatgttgccgctccaccaaatggttcgatctctgttggatggttatgtgtctcattcttgaaactgatcagccattcttcttccttaccatcaatttctactggtacaacaatgctgcaggcgttgatctcatcactttcttccatattgtcaagaattccatcttttttaagacgtttcatcgccattaatgccatatccattaagcagacatatttgtcatcacggtctttgtacatctcttcaaagtcatccatgtaagaataatatgcttcttctaatggtgcacgataaaatccatcctggaatccaatgcttgtaagttctgtggagaatgttgtatgacgacagtgatctgaccaataagtatccagtacacggatctctgtcatggaaggatttctcttttcttctcctttataataattctggatatgaaggaaatctttgaatgtcatagcaagatttaaagaatcatataattctttaaatttgtcttcttccatatctttgaatccatccagaatcttaacatctgctggttcttcaaaatccatcactaatgtctctggtttgtctgcagctgcctctcttgagtcaactgggttgatgcaatattctttgactgcttctaactgttcgtcagttaagtcaccttttacaacataagttgttgcacttctgatcagggcatcttcgtcctcattcaacagtttcacacactgctgtgcagaatctgctctctgatcgaactgacctggcagaaactcaacgctgaaagatatttccccatcggcaagtggtaatgtctcttcatacacgtcgtcaactggtggttcactaaatactgtaaccagtgctttttcataacttgcatcggatagattctcgatgtcatagcggacaaggacacgaacagattcgacatccagtccaagatactgcttcaatgatgcatgcagctcttttgcttttactgcgtagtcttttttcttttcaacatagactcttctaacttctcccatgatttcctcccatttattcatgtagtttcttaatcacctgaaatgcagatgcattttccaaaatcgttggctgatcctcggcatagaatatgattccatctgccgttgaacggatctctgataaaatctctccattatatggattaatgacttcaccaagcagctgacctcggttaacttcctcattgatcgtcacaaaacgtcttaggaatcccggagcacttgctttgacggatacaagatcctcttcttctataatactcgcaatatacccgttatggcaattatattttaaaatacccattcgagtcaagaagcgaagcacggcagatacagccttcctggccaaattcacatcgatattatctgtttccccagaatataccgaaaatgcatccgtcccattgatctgccagttataagttaatgtctttttatcaaaatttcgttgtttgcttgttaatacataaggcagcccgaacagacttgcaaggctggtgctttcttttcctgttgcaggcattcgcacatgtggcacaaaatccccgcttctaaaaaatgatgcaaaatggattccatagcggaatcctttaacccgttcaaataaatgtgctgccagacggcttgttggttccccatcaaaattcccaggaaactgacggttgatatcactgttatcagatacccagtatttcattccgacattcattgaaaaattattcacacatggaatgaccagaatctgattatctccaacgatcgcaccactgttctccagttcttttaaacgtttgactaactgagaacaaatatataactgctgatattcatttccacgcattgctccaacaatacatgccgctggttctgatccttcactttgtttcccaaagagatatccttcgatcttaaactcatctcttaagtaatttcctgaggaatatatgatttcttttttcatagtgcattccctccgatcactctggctaccaaggacccttccgttacacttggatgttctcttaatgtcatcaaaataccatcggttggtgcaaccacttcttcttccgttgctcccattaaaggattctgtacgatccctatgatctcgcctttctttaccggatcctttaatcgcttgtaagaaacaaacaatccactggattcacaatttaaataaaagatctggtcttcgtggataaacggaacctttgttttgccttgaacctttcccttccagataccaagtactgccatcaccgaaaaaattccatctatgatctggcggcagtactcgtaacggatacgaaatgctgcaccggattccgtaaccatagttgggattcccatctggtttaaagtgaaagctaaacttccttcattcactgtctgagaaggatggatccagacaagatccgtattcatatattttgacagatgaagtaatgtctcatcgtaatcgttatttaaacgtacttgaggaacttcctgcaaaaagatattactagaatgaatatcaatgcaacaggatgctcctttgatatcttcgatcaatttagctgctgtataatcttccagacctccattgatgtctcctggaaatgcactgctgtaatcgatatctgagattggtactgctcttgttcgtgcatccagtcctaatggattgaccgctggatacacatcgacaatacctgtcagattctcaaattctgccttgatccggcgaatgatctctccgcagatatactgtccgccaagctcatctccgtagattccagacaccagacagattctcttctcctctccagtcaccacatccggcatcagacgatttcttttgatccttagcatctctccgatcggaagttttacagatacgactgtgtctatcatattaaagcctcttttctattgttttatctgtatcgtaaatattttatttttgaccctcacgtcttattttgcaaataacatttttaaaatgatcggtgataagagtgttgtgacgagaaccatgatgactactggtgcaaaaaaaacttctgataataatccaacagaaattcctttctgtgcaacgatcagtgcaacttcacctcggcataccattcctgctccgatctgtacagattctctcttcgtatatttgcacaacaatgctccaaaaccacatcccgcaatcttcgagatcactgcgatcacacataaaatgatcgtaaagatgatcaacgtctgtgtcattccatgaatgtttacattcagaccgatacttgcaaagaatactggtgtgatcagcatatacgataaaacttcaatcttgttgtatatataaaatcgttctgggagcctgcataaaatgatccctgcaagatatgcacctgtgatatcagcgattccaaacacttctgcaagaaatgcaagtgctaagcaaaatgcaagtgcaaacaccggaactcttcttctatgacgttcaatctctggattcttataagtagaaagccactcaaagaacttcttgatcccaactccaccgataatagaaatcgcaaagaatgctgccatctggatcaagatcttaaggattgcctgaatatggaatccagatgctcccccaaggcttgtcataattgataataaaacgattcccaagatatcatcaatgatcgctgccccaaggattgctgttccgactcttccttttaaatgtcccatatcctgtaatgcttctactgtgatacttactgaagttgctgttaggatcactccaataaagatcgattccatgatattatttccatatataacggataaaacagctcccatgataagtgggatcaatactccacataacgcaatgacgaatgcgggaattccactcttcttcaactcatcaatatctgtctcaagacctgcctgaaacattaaaacaactacacctacttcagccagatttaaaactgaatctgaaggactcactacattaaggaccactggtcctaaaatgattcccgcgatcaatgctccaacgactggcggcatgttaaacttcttcgacacaagactaaaagacttggtcattgccagaatgattgcgatatccagcaaaaacttatattcttccattgttttacctccattagttcgtatcgtatcatacctgttttttcttgtcaattcttagacaaagtgatctttttttatccttttcttgctttttttatgatcctttagtatagtggagaaaagactaagaaaagaggtatcaaaatgagtgaatttaacgaagtagataatatcattgaagaagaaactcctgtgctccatttagaattagaagatggaactgaacaagactgtgccgtgatcgctttattctctgtagaagaattagatgatcaggaatatatcgcattgatcactgttgaagacttagaaagtgatgacgaagaaggggctttacttttatatcgttacaacgaagaccctgaagatcctgatactttcagtcttgacaacattgaaacagacgaagaatatgagacagtcactgctgtcttagatgagatcttagaagacgaagaataatatgatattaataaaaaagcccttgcatcttatatgcggggctttttttcatattgaagttttgttcggatcactttgtcaagttcataatacttttcttccagagtttttccattcaggacacaatccattgccatacccatggattccagcatcgtttctgtgatctgatctctatactgtaataaaatattcaggcgctcatgaagatctgtttcatctaagaatttcaacagtggctcaatgtctgctgtttcttctgtctcatcacattcattttcctgtgctgtcacttcatcaaccagttctgcttctgaatcttgttctgtctccgtgatttttataccatactggtctcctgcattttcacacagttctactttccgaaaacggtatatctgttgcacatctgggtatttttcatgatcgacttcacttaagaacatcgcaagtggtcttgcatatgtcttaaacgttccatacattgcctgatagaccaccaatggttcttctgtctctgtatgtattgcaaccgtaacgatctgataaagttttcctttaaaatgcatataaaattcgcctgctcttggcatcgctctattttccatgcaaaacacctcttttctcctgacggcttcttagttcttctacgaaccttgacggcctgctgtctttgttataaagtttctttactgataagatgtgcagatatttcttggctcttgtaactccaacgtaaaacaaacgtctttcttcttccacgtcttcttctttcatggacttcttatgtggaatcacgtcttcattgacatctggcaaaaagacacgttcaaattccaatcctttggtactgtgcatcgtgctgaccacaaccccttctttttctttctgattctcttttgactggcggtttaattcttcggtgtattctttgatatgatcaaaccatgcctcatatgtatcatagccttttgcgctctcctgaagttcttctaatacttgcgtaaattcttcttcctgaattttgcgaaatcttgcatattctgctaaatacgcattgtatcccacagattttcggatataattgatcgccatcaacggagtcatattcttcatgatccgaagatcttccttaaaatcttctacatattcataaagccatggtttatctttgaccttgtctaacagatcatcaaatgacacttgtgattcggtcagatattccctgctgatataacgcttgggacggttcatgactcttaaaaatgtgcttcttttgcgatctcccatcgtaaggtgcatataatctatgatatttttggaaatccagtgatcaaacagattcggcactgcatcctgcatataaaatgggatattgtatgccatcaatgcagcaatcagctgtcttggtccctgattggtccgataaaggatcgcgatctgggataacggtgtcttctttgccatctcttccttgatcgtgtaaatgatatgcttattctcctcatagtgatctttaaatgtacggacctcaaccatacttgcagcatcttctcttgcctgcatcttcttttcaaaacgttttgtattataagaaatgatatcttccgcaacctgtacgatctcttccccgcaacgatagtttcggtttaagatcacctgtctggtattctcaaaatcctttggaaaatttaacatcagttctggtcttgcacctcgaaacttataaatagactgatcatcatctcctacgataaagaggttctttgtctctcctgctaacatcttgacgatctcatactgaatcttattgatatcctgaaactcatcgatcaaaatatatggaaacttctgctgccatgctttcctgatatcctcacgctcttttaacaactcatacgtataaaccaaaatatcatcaaaatcgatccaacggttctcatgcagtttttcttcatatgcacgataaatttctttaaacacttcatccccacagcatccactgtgataataggcaagagggatcatctgccctttgactaagctgatctcttgtatgatctgacgcataaaatctgcttcatcatcaatctccaactcatgatctgtgatgatctcacggataaagtcatattttttatgttccggcagaatattatctgcactatagtgataggcatattttaaaatcgtaaaaaacacagaatgaaaggttccaaaagaaaccggcagggtttcccctgccagccgccaaaaccgctctttcatctcattcgctgctgctctggtaaatgtaatgaccagaatccgctgcggtgggatctgatagtgcgatatcaaatattgaattctctttgtgatcacaagtgtcttccctgaacctggtcctgcaagtaccatcatcggtccatctttgtgcatcactgcttctttctgtgccttgctcagctggctatgcaagtgctgcctccagtttcgcgatcgcatcattgattctctttaatgattcttctttccccagaagttccattaattctgttgctccacctggtgtcatctgctttccagaaactgctgtacgaactggccacatcacataaccattcttgtactcatgtccttttgcaaaagatactaacatctcatataatgcatcatttgtaaaatcttcctgtgcttcgatcactggatagatctcttttaatacggttaatgaagtctcaggtgttgtcttcatcttcttatgtttgtacatctctacatcatattctggaactgcttcgaagaagtcaatgtgtcccggaatctctgtaaataactcaattcttgtcttcaccatagaaagaatcttatcaaaatccatctctctgtgaattgtctctgttacatatggcatagcaagttctttgaaacggtcaaagtccatggctttgatatattcaccattcatccatttgatcttgttcatatcaaagaccgctggtgtcttagacatatgtttgtaatcaaagatctcttctaattcttttaatgagaagatttcttgttctcctcctggactccatccaagtaatgcaacgaagtttacgatcgtctctggcaagaatccctgctcgatcagatcttcgaaggaagaatgaccttttctcttactcaatttgtgatgttcttcgtctgtgatcagtggacaatgaatgtatactggtttttcccatccgaatgcatcatataaacgattatactttggtgtagatgataagtattcattaccacgaactacatgtgtgattcccattaaatggtcatcaactacgtttgcgaagttgtatgttggatatccatccgatttgatcaggatcatatcatctaattcgatattatccactgtgatctctccgtaaatctcatcaacgaaagatgttgttccttctgttgggttattctgacggataacatatggtactcctgcgtctaatttcgcctgaacttcttctttggataagtttaagcaatgtttgtcataatgactgatcacaacatctcctgattttactttcagtgtgtctaatctctcctgatcacagaaacagtaatatgcttctcccttgtcgatcagttcttttgcatattttaaataaagaccctgtgcctgtctctcgctctgaacatatggtccgactccaccatcgatgtctggtccttcatcgtggttcattccggctttcttaagggtattgtagataatctcttctgccccttctacctgtctttcctggtctgtatcttcaattcttaaaataaaatctccgcctgcatgacgtgcgatcagatatgcataaagggctgttcttaagttacctacatgcatacgccctgtagggcttggtgcaaatcttgttcttactttgctcatgatttcctcccatttggttttaattctatctttctattctacaaaacttatctttctttgtaaagaagcagtcttattgattttcgttaatttatgttgattttttgaaacaatccgtcttaaatctcatttaagatcctgctagcttcctcaaatggctccagggttctctttaaaattccttgcgttgccgcgataaagattccatagttcacgatcggaacacctgcatctttgactcttgcgatacggtttttcatctctcttctatttaaagtacatccgccacaatgaatgaccagatcataagtatccagatcttcagggaaagagtttccactgcttgtatggatatcaaaatccttacctgtatattgttttaaccatcttgggatcttcaccgttccgatgtcatcgcactgtctgtgatgagtgcatccttccgcgatcaagatcttcgccccttcttctaaatgttccaaggctttcactcctctgacttcttcttccagatcacctttatatcttgcaaacagaatcgaaaatgaagtcagtttgatatcttctggcacaatctttgagactttgccaaatgcctgagagtctgtaatgaccaatgctggtttcttaccgatctcttctaatgtcttttctaattccgtttctcttacaacaatagaggctgctcctgcttctaaaaggtcacggatcgtctgctgctgtggaaggatcagtctgcctttcggtgctgcactgtcgatcggtacgactaagatcacaaaatcattcggacagaccaaatctccaacgatctttagcgtgtcatcatccgttggaaccagtttcccgatgtcttcttttaactcccagattccttttttatcctttgcactgacaaagcaggctttgtcttctttccattcttgggcattggaaagatccatcttattgtagactttcagataaggaatcttccggtcttcgatcaagcgtatcatatcttcttcaaactctgtcataccagctgtagcatccatgatcacaagcgcgatatctgccttgcccaagacttcttttgctttcttgactcgcttttcccctaattctccttcatcatcaagtcccggggtatcgatcataactactggtcctaatggcagaagttccattgccttgtatacaggatctgtcgttgttcctttgacatcggatacgatcgctaattcctggttcgtcatagcattgataacacttgacttcccggcatttcgtttcccgaataatgcgatgtgaattctgtctcctcttggtgttgcatttaaactcatatggtttcctcctgtctgtctttatggatcgttaactctttcttttatctttgtgccttatgatatcccgctacctttgcttctttctcactcttaaatgtgactaaatattttgatgttcccatacggtcataatctctttgacctgggcagtggtatacctttgatctgctatttccacggatcttctgtgaagcagttgtctttgtatttgtttttgctgctgttgtatttttgttactgctgttgtttttgctgttattagatgaattctggtttgtgtggtatttctggcttgcttttgaattctctgttgttacctgcacgctgctgtctgcttcactgtctcctgtctcgtaatcaatcttcactccatcctgtacattatatacaaaaacattaaacttaatatcttcgcccttatcttccacagacatcgcttccatctgtacccctttggctaccaggtcatctccgtcaaagactggtgtaactctgtataatacatgattgcctgtctcacggacatagtcaccgaccatctcttcatatggtaacattccatccacgttaaaagatcttgttcctgtgatcaggttcttgttattggcattctcaccggtcagctggtaagcgatcaaatgacagcggttatatagatatttcccatcaacgttatcgtattttgctgtatgccatccggttggttttaccataccgatcgctccacgttttccttttggcatgatatcttttccaacacacgcttccgccacctgacatcttccttcagagtcaagtctgctgtaagactcgtaggattttgttgtcagatctttggatgtaaaatctggattattattgtcaacagcaaccgtcatattccctgaaaaatccggaatattatccgatgatacagatttggtggaagaatttgtacttcctttgctgctttgttcgctctgtgcgtttccgccattactgctattgcctgtactctggcatcctgccagtgataccgccatcattcctgcgatcagcagggcatataatttctttgttactctcatcatcaacacctcttgttatattcttttctgatctagcttattattttggaagatagatctgttttgtgatctcgtgagtggaaccttcgatctgttcttcttctgcaagtttccattcctcaagatccacatccagtacctgatcggacggatagactttattccaccggaagatcacgatctcttcgatctgatctatcactggttttaatggaagattctctacaatacaagtctccccttttcctgccttgtgtaagaaatcttcacaaacaaccggatcattgatctcttcatacaacttctctgtatatgcattcatatagaccttctcccctttggtcatctccgcaatatactctcgcaagcctcgatcctgactctgtcttcgatcattaaacatcataccgttgttgttgtctaagcatagaattattatcattctctccatcctccaatcgtacttatgttctatttatgtattatatcttgtgcgagaggatattgcaataaaagaagctctgaatttctccaaagcctcttcttacttttcattcttttttgtattctaattgtatttatgatactgctttcatcactttttctctcataggctgtgtcattttctctggttttaagatctcttttaattcttcttcctttaacaagccttcttctaataccagctcttttacagaaattcctgtttttagtgatttctttgcaatctcagcagactttgcatatccgatatatggacataacgctgttgagattccaacacttttttcaatatattcttcgcactgtcctttatttgcggtgatccctgtaatgcagtgttttgtaagtgtggctgccgcctcttttaaggtatcgatggattcaaataaatgatgaaataagactggttcaaatgcatttaattctaactgtccggcttcggctgccatcgtgatcgtatagtcatgtccaatgatcaggtatgcaacctgtgatacaacttctggaatcactgggttgatctttcctggcatgatggatgaaccattctgtcttgctggaagattgatctctgataaaccagttcttggaccagatgacattaatctcagatcatttgatatcttggaaatatcaacggcacatgtttttaacactctggatacactgacaaaaccgtctaagttctgtgtggcatcgatcagatcttctgcctgttttaatgaaattcctgcaactttgcttaattcataagaaatgttcgcaagatagtaagggtctacattgatcgctgttccgattgctgttgctccgatgtttaagactttcatctcatccataacatttttcagtcttttgatatccctttttaagacatgtacaaatgctccaaaactttgtccaagtctcattggaacggcatcctgaagctgtgttcttcccattttgaggatatcatcaaactctgcttctttttcttccatggctttttctaatttctcaagttctttgatcgtctgtggaagtaattttaagacggtgatctttcctgccgttgggattacatcgttcgtagactgtgacatattgacatgatcgtttggatgtacaatgctgtaatctcccttggttccaccaaggatttctatcgcacgattggcaatcacttcgtttgcattcatattggcagaagttccagcccctccttggatcgcatccacgataaactgatctcttaaatttccatccagtatctcatcacatgctttgatgatcgcctgagcaatctgctgatctagttttccagacttttcatttgtgatcgctgctgcttttttgaccattacgatgctgtcgatcaatactggatgtaatggacgatgtgtgatctgaaagtttgtggctgcacgcatactctgaactccatagtatgcttccgctggtacgtttaatgctccaattgaatcgtgttccattctgcttaacattgtcttcctcttttctgattactcatgctgtcgttttgtttcaagattttatgtgttggagcttaacacagtatgcaatgttcgtaaaccttaatcctgtctttccaaatttaaaattcaaattttgtgtttcatcttttctttttttaatgaaagtcttgatttactttaaataattaagcggttggaagcggaaggaattctgactggatttcatgcttctgttgacccgatccaacttggttatcatattaaagcatatatcagtcttgagatcagccctgcacaaaaacccgaagtttatccttttcttcgagctcatccaaatgtattggaatgtgattgtgtaactggaaattattctgtgctgctgaaggttgcttttcctagtacgatggaactggatgaatttattgggaaattgcagcactttgggaagactagtacgatgatcgtgttttctacgatcgttgagaatcgtggggtggttcctgaatagttgatttgtttttaatttctgttatctaaaataacagggtaaaattttgcatatggaacattttcttttataatttgtgcaacctttttacttattataatttccctatactcatcgtaaaattcatatgtcttatttacatcctttaaattttttattccttcttctgttattcttttcggtatgaaatagaaaatgttttcattttctgtcatatttattctttcacatttttcacattgattttcaaatttataattttcatcaatataacttttctgtggtaatatattatcagtaataaaagtatatcctaatatctttttacttttgcttataatcggctgaaaatattttttatctactcctgatttttttaatttctccaccagttttggtaataacaacaactctcctgttccatccaatcctgcaaacccataatcattctcatgtttttttatatatcctttcggttgtgcataaaataagctatttgttttttctttactatgacaactttcacattcactatattcattttcaatatcttcgtattcttcacagtaatattctggaaaacataaaacgaatgcttttgccttttcaaactcttcatctaaaacttctacatcataacctaagcagataaattctacatctttcctatttgatttataaaattcaattatttgtttatatagttctgaatcttgattaatcttatatgtatattctccagcaaatcgatttcctgttctgtatttctttaatctgtataaaaatctagagataattttttttacttttcaagattgtaattttacctttgaaaatccagaaattaccaatcaccaattcattgggtcccgattttatatgatctaaatctgtttcacttatttctttttctattatttttttctctgttatatgataatccgtataatcaaacttgcctgcatatacatgaattccatctctttcattcttaatcatatcaatatcatccttaattaagatactcttaataaagtcgccattcttgttaaatttctgaacgacacctaacattccagtcgcaacatatatattccctttgtcgtcaatggttgctttattccctggaaaaataccaacaggtatggaatatgattttttaataaaagaatcttttttattttgtaattgtatattacatactatcattgttacaaagtctttaacattacttacagtaaaaatatttcccgaaaatattgatctatttccgaattacttggaaatagttttttaatttctcgtaaataccattttcttttttttatccatttttttctctttccttgtaaaatgcaaatataaaaaatatatacttcgaatttttcttgattattatcatatagtttttttattatattttttccttcatcaactatattataaatatcattttccttatttaagaaaaataaatattccgtggtcgcataaaaataacctgtaagtaattgtattttgatattttttttaaaaaaccttttttgatattctactaattcaaaaaaaagttttttttcataacaatctttcttataataatctataacattctccatataaacttcttctaataccatccaaagctgtgtatataaaagtaagaaaatatcatctctcttattttgtttccacaaaatatataactctcgattcgtttttccagtttgatttgaagaaaaaaatggttgattatcataaaccaattgttttaacccatgcatcacttaattttacaactcctttcttagctatacatgtaccttcgataattttctctttataattgtatacaaatttatatacaatttcttttcctttagtttttcctatagcttccatttttccacttttcatttccttttttacaattggttttacatacttccactgattcttttttgttacttttgtccactcatgtttactctgcataatgtgccttactttattttgatcagaagctactcttcttattgcactattgactccttttaccgctaatccactacttgatgatgctcccatagcaaccgataccataacctgcaaatgctcctataatggctcctactacagctcctttaattccatatgttgctataaataaatttctttttttccctttatatcctaatcttttagcaactaatctacctttatatgaaccagctactgcaccaacaattcctcctacttcgacacctactaaaactgctgtacttactaaaaaatgtccactaggatccacataattcaccggattattcgcacaatacacatataaatgtcccgtctccgatttagtcgtatctccacggtaggtatcctctgtcataaatctaccatcttctggattataataccatgcattcagataatacaatcccgtactctgatcatagattccaccagtataacacacttcatttttcgcctgatcatctccatgaataattgtctctccaaaatccgtatactgataggttgcatctgcacttccatcttctttcactaggctagttgtacttccctgaatatcttcattatacagataatattgcgtatcatcccctttgaatctctcagttgcaaggacatttccttctgttccaatcaagttctgtgtaagtcatctcttttacacggtcaaaactgtcataggtatagactttttaaactgcctgatcactgttatttaatagatttctgtggtctttaatctctttgacttttccataagcatcataagtgtaacttctgtgacttcgtaaggtctcagggaacttaagttatgaaatctcaagttactcaaactttttcttaatgtccctggaaacttaagtaacttataatataatgcatttaaggtacctcagaccttacgatgtctgctggttgatatcatatatctctaaacaattcagctaatccaaaacacattccttcatgtgctattgtttgtaaaataattttattttctgagacaaaacataaatctatccagtctgcaaaagcataaatattaggatattcttgtaaaacttttcttacatccttgttatatttatataaataccaattatccgtcatataatatcccttttttcctttttcccttttaattatagttccatttttacgacataatctactttccaagaaaaatttttctaattttttaaatattaaacaattcttagtttgtaattcttccctttctttttcctccttactttttaccttctcaattggtatttttaatattaaaatattactattttcctgaagtatttttaatatttttttatattgggttattactaattggtccataccaaaattgcaaatatcttcatacaccataattattaaaatcctcctattttaaaaaccaacaatgtacatgcatttgttttctcgcatttttatttttactccactttaacattggatgataatgataatattgttttccctgatctttttccttcttgtgtttttgcattgcagatactttatgaattgggcttgcagctttacatgcatcataagcatatccagaagatgtcacaaaaacatttccatttgctttcaatctcatagctgctttagatttagtctttatatcatcatatatatatactttcgcatttatcctttttgctttataataatgtatcttaggttgttttcgctttagtgttgaaattgcagttgcagcaacatatgtaattccagctattacaatatatttaagcgcctttaaaataactcctcctaagtctttcttaaggtctctgggaccttaaggatttttactattcagacaagattttttagaatacatgaaactccaaaatgcgtatactataattccagcagtagtcaaaatgaaatgaatagtctgtaacgacaaaaaacgaagacattgataccgtagaccttaagaaattttaagattctgtgatacctataaaaaataataattatccttatttactttcattttttttataataaaacaattcggatattctttaaatcctggaagtgttgatctatattttttcattacacttcgtgcttttttccaacttccaaaataaccaatcataagtaaactaccctcatcttcatatgtcagttgatatatatacatatttaaccacctcactccctaaaaatatttttccatccaaagttttcaatttcatatttttggtttaaaaatttcaacatatcttcatatttatttattttatatagaatctttctttgttgtttatctaaacaatacatttgtccattctcagtattttttaaacacaaaaatttttcatgatcataataataatccatttttccattatacacttttatattttctccatattttacttctatatcatgattttctggattatattcttcttctttttcgatcatataattatttaaaagttttattataaaatatgattttgttgctctccaaaaaccttcattccactctgcttcattgattttatattcattaatttccaaaaattcctcttttcctttaaatcttggttgttgtgaaaattttttctttcctatttctgcctttttatatgatgaatataccgcaataattatttcatcattgttttctgaattatcctcataatacgagaatttcaactcataaatcatgaatatatttgcacctccatttatatttttactgtatcaattatcgtcctctatctccccactttctcaattcactatattcctttccttgctttccttttcttgtccattttccttttccataatgttcattcattttcctaattacatactcatttccactttcccctttttttggtctagatccatgtgcccaacttggaatatctgtcgctctttcttttttactttttttgattctttcttctttttagtattactttttttcttacttttactatatattatcctatccactactcctgctgtaagccatacagatacttttgttttagaaataatttttcttcctgcatattttgtttttgaactatgatttttccatgatgaatatgacacataagctaccgcacctccaacaagtactaattttataactgtatacattgctgccgcaaaatgcccactaggatccacataattcaccggattattcgcacaatacacatacaaatgtccagtctcagggttcattatctcgccgcgataactatcctctgtcataaacctaccatcttccggattataataccgtgcattcagatagtacaaccccatactctaatcataaattccgccagtataacatacttcatttttcgcctgatcattaccctggatcgttgtctctccaaaatccgtatactggtatgttgcatcagcacttccatcttcttttacaagactgcttgtactttcctggatatctttgttgtaaagataatattgtgttgcattctgttgaaatctttctgttgcgaggacatttccatcggttccaatcagattctgtgagttttgctctccattcgcatctgtcgtgtaagccacaactccattctgataataatagttagtcgtctcatctccatcgaccttctggatccgctgtccttctccattgtagatgttctgctggatcaccgctgtctttccgtctttcgtcacggacacctgacttaatctgttttccgcatcatacacataagtctgatcttctccagtctttgtgttctttacatctgtctgatttccattcgcatcgtaatcatactgacggacttcttctaccgcagttccttttttttcgtggatgtctttaactgatccagtccgttataagtatacgatgttgtcgttgttccatcatcttctttgagccggtttccaacattatcataggtatatgtgattgtttttgtctggtcatttttcttataatcggttgtcactgttttgaccaatcttccaaacgtatcataggtataacttctgaggactttctctgttgtctgccccttggaatgcagttctcctttgatctcctgcagccatccgttctcatcataaatataagacaatgcctgaattccatctttggtggtcggataggataccttactgagatttccatcctcattataagtatactggatctaatgagatttgatatcatctgtcgttggctgagcattctgactgatcttgcaaatgacttcgtaatgtccagggagcttaagttccttttttattctcgattaaatttttgtatatatttttttatcttctttgttcctctccttaatgttgatcttctatctatcattattattattacaaaacttatcataaacagaacaaaatctgtcactttgatccatcccatgcataaaaacaacacatataacgttccaaaaatcaatatgcctggtgctggaatttcctttatatattctattttttcaagcttcgtacaaccttttaactcactattttcaagttttccatcaaacataacaacttcatttatattaaatggatttttttcatatatatatattattttcactatatcttcttcaacaaatcctttaaacactgtaatttctgattcatctatatctggtgttatataatgtccatgtaaatagtcttctttatcattaattaattctaaatcttcttgtattaattttatccatttttctgtattttttatatgtacttctattttttgcatcttcataatattatcctaattaacaaattttaacttcgtaaggtcccaaggaccttacgattccttcgggtacattagtctacttaatttattttataagatttaattagtttgtataatgattccgtatactcatgattaccattttctatattttttctatattgttgtatatatttttctactgtatttcctttgttatcttttaaactaatatctgcccctttttcaatcaataatcttatgattctatattgttttcttgtatttattcccggttcttcctcataattttctgagtaacaagctgccattattgctgttatacctttctcatttttttgatttacatccgctccgttttttaagagtatttgcactaagtcataattattttttgttactgctactactaatgcatttttatctggatctgcacctttatttaataaatattttatcatcttattacaatcttgttgcccgaaataataaatatattctgatagaagttcatgtccctctttatttaaatttgctccattttttactaacatttttataaaccgatcaggatacgacattgacattaatgctgtttctaatggtgttgtattattttttttatctatctcattcacattttctccaaataacacttttattctagcaaaaacataattacctgttattatatcatattgtaaacttccttttcgataatactcggttaccatactagattctcgttctttatattgtaatgtccatggcatattaaaatacaaataataaccaatcaataaaaatattattactatcagcaatttcaaaatatttttcacaatcattaacctccacacacctgatataattagctgattaatccaagttactcaaactttgccacttcttccattcttttttgcatatctattcctgtaatccttgatctctttgacttttccatacgcatcataggtataacttctgaggactttctctgttgtctgtcccttggaatgcagttctccttcgatctcctgcagccatccgttttcatcataaatataagataatgactggattccatctttggtggtcggatagaataccttactgagatttccatcctcattataagtatactggatctgatgtactttgatatcatctgccgttggctgagtactctgactgatttccgtaaggtctcaaggagcttaagtttttgtactgtgaggttcctgtttttgtctattgacattatttatgaattacagaaatgcttaagattctataaatacattctcattaaaatattgcataattttttctgtttcatctttaaatgttttataaaaaccaaaatcacaaaaaattacaaaaattataatatacaatccccaatacctattattgggagtaaacataagtataagaagcgaactaataatcagtagtatatttgctattattattattagttcagcttcaaaatataacgaatatctcattgtcattatagtattttcaccattagaatacatcttaatttttatttttggaataaatcccctattttaatatatttacaattcatcatttgtgactaaaaatcaagattccgagatttcgtaaaattatttacttctacacattcttatttttttgtttttggatacagcaatttttacaaacatgtttcccagaaaatatattaagaaactatttactttctttttaataattgtatatcttcttcatctactcccaaaaatgaaatagtgtctatattttctttttttaatattgcctctccatcatcctctccgtattctgttaattttgaaacgattactttattatcatcaattttatttataactcctttaattgggcattcatcatcttgtatcatttcaattgatactatatacttattattcatacaaatttgaaatatattattctttaaactaactttatcttgtagttttaaatcaatatgtctttgattctttttagaatataatttttctatttttttttcatactgtccacttatctctaaatgcataacactatctatttttttcagaatatacccatctgctaatccatgaggtgttatatgtttaattaaaaaatcttgtcttccaattgcgtaaatatatccttccaaaaacatcgaagtatcatcttcatcgcaaaatatactaactatattattattttcttttatctttatcaattctttaatcatatttactccttcttccatcatatcttgtcttcagactatgatctttccatgtagaataagatacattccactagtatagcacacttcatttttcgcctgatcatctccatggattgttgtccctccgaaatccgtgacttcgtaaggtctcagggaacttaagttcatacagtatcctgatatgtcgttttcattctccctttatgcttggattgtaacatttcaccattttacaggcaatcatatttagttttttcgtcgtttaatacaaaaaacttttttatttttgtgaaatattatggttgacttttttaataagtatacctacttaatatattgttccattactatacaaaaaaagaaccctgataactaaattaccaaggtcctttccatattcccgtaagaaactaaatcatataatcttagcttcttgctctttcttctaataaagcttttacttctgcttctgtttctaactgcattacttcatcaactaatgctttacattcatccattgtccacagagacattacttttcttgtagcaaggattgctgtagcacttactgagaattcgtttaatccgaatcctaataatactggtactaataatggatcgcttgctgcttctccacacatacctgccatgatgtcttctttgtttgcagctgagatgatatttctgatagaacgaagtacagctggattgtatgcagagtacagatatgcaacatctgggttacctctgtcggctgccattgtgtatccagttaaatcgtttgtaccgatactgaagaagtctgcttcttttgcaagaatgtcagcaattaagcttgctgcagcagtttccatcataacaccaacctggatgtctttgtcgtatgcgataccttctgcatctaattcctgtttcagttcttcgatgattgctttgactgcacgaagctcgtctacacatgttactaatggtaccatgatacgaactttaccgaaggcacttgcacgtaataatgcacgaagctgtggtttgtaaatatcttcttttctctgtaagcagaaacgtactgctctgaatcctaagaatggattctcttctgttggaagtccaagatatggaagtgctttatccccaccgatatccagtgtacggatgatcactggtttaccgtcaagagtttcagctactttcttgtatgcttcaaactgagcttcttctgatggaatcgcatcgctttccatgaataagaactcagatctgaataatccaacaccttctccatcacgctctaagacaccttctgcttcgtctggtccaccgatgttagcaaccagttccacaacatgtccgtctgctgtctgggatttctgtccaacaaacttctgaagggcagctttctcttctaagaattttgctttcttagctttatattcttctacaacagatgcttcaggattgatgaatgcttctcctgttgatccgtcaagaacaacttcatctccatcattaacgatagaaacgatgttttcaatactaagaactgctggaatttccatagatctgcagatgatcgcagagtgagatgtcttaccaccgatctctgttaatacaccctgaacgtttgcaggattgattcctgctgtcatagatggtgttaaatcttctgctactaagattgttccttctggaactgcactgatatctacttcttcaattccaagtaagatcttaattaaacgagttttgatgtcgcctaagtcagatgctctctgctgtgtcagttcatcgtctgccatagcgaaaatctgtgcgaagaaatcgcaagcttcttctacagcagcttctgcattgatcttctctccatcgatcttagcttcgatctgttctgagatcgctggatcctggatcatcatgatatgaccttctaagatttctgcttcctgctcaccagcagttactttcatggattcaaccatcttctgagtcttctcaatgaaaacttcaattgcatcgcttaaacgttttttctctgcttctgtatcttcgatagactgttttgtgtaattaagttcttcttccttaatcttaacgatcttaccgataccgataccagcagatgctcctatacctttatacatgttgccacccgtcctttatcaaattatatgttacacccgttatgagcagtgattattcacctaatccagattcaatcagttctgttgcatgtgcaagagctgcttcttcgtctggaccttcacatactaattcgatttcagaaccacatttgatgcaagctccgatgatgtttaataagcttttagcgttgatttttttatcttcgaatacgatagttacgtcagattcgaatttagttacagctttcgctaaaactcctgctggtctcatgtgtaatccctgttcgttttcaatgacaaatttctttgataccataattgtttctccttctcacatataaaataattttaatttatctggatctttaactggcttatctttgtactcatctaagtgcaattccttaaaaaagcataaaaaaagacctactttaacaaatgttcacacttattaaataggtcttgcctgcctcaccagtcacaatccaaaattcgataatattataatatcaaattttgccttataagtcaacctggttttatgactgatgccccatttctaagatcagtcttttgacataaatgatcagatacatcttctcatctgctgaaagtttgcagttgtaatgctgctcgatatgttccacgatcttctgactgcacacataggcttctggatacttcttctgattacgttcataaaattcaacatcatcttcttcgtcttcttctatcgggcgtttctttgataagatttccgtctcaagatattgtaaatgtgttgcaaatctctgatatgctggatgttccgtatctagcacgatttcataaaactcctgaattatcgccatgacttcttgtacaaaagatgatttgccgctaagatccaaggtaaaaatcttctcaatcttcgtcttatctaattcatccccggttttcttgcgaaatccaattccttttcccatcaaaataacttcttttccgtttgaatcaaatgtactgaccacgttattgttaattactttctgtatgatcactttctcgcctcctagatacttccaagaatctcttttggaatgtatgcttctacgtaaattccatcatctctgtattcttctttcaaaagctgtccgtgacttcggatcagctggatcttacctgcttcctgatatccatacagcttttctaaatataatttctgtttttgcagtattttctcaatctgctctaacaactgatcggttccttcaccatttttcccagaaatccttaccaccgcttctgcatttggatcttttaagatctcatcaccatttaacagatcaatcttattgaatgctgtaatgatcggtgattcgttagctcctaactgctttaatgtatcatagactgcttccatctgtttctctttctgcggattggatgcatcaactacatgcaggatcagatcactgtatttggcttcttctaatgtacttttaaatgcttcgaccagatgatgtggaagtttgcggataaaaccgaccgtatccgtcataagaattgtctgcccaccgcttagatctaaactctttgtcgttggatcaagggttgcaaataactgatcttcttcataaactcctgcattggtaaaatggtttaatagtgttgactttcctgcattggtatatccaacgatacaaaccactggcaggtgattcttctggcgttgttttctctggacttctctgtgctttacaacatctcttaactctgcttttaatctggagattcttgtacggatcagtcttcggtccatctccagtttcttctctccaggacctctggttccgattcctccacctaatcttgataaggctcttccttgtccggtaagcttggatgctctatattttaactgggcaagttcgacctgaatcttaccttctcttgtaaatgctcgcttcgcaaaaatatcaagaatgatcagtgttcgatccatcactttagtatctaatgcttcttctaaattgctgatctgtgctggtgataattcgtcatcacagacgatccctgtcgcatcagttccgtataacaaagcattgacttcatcgatcttaccttttccgatataagttcctggatgtggtgtttctcttacctggatcacccttgctgcaacctcggctcctgctgttttgaccagttcttctaactcatccagagattcttctgcttctgttgtgtcttgatcagcaaccgcgaccaagatcactttctctatgatttcttttttgatttcttccataatatatgttcctgtatctattttcctaatttccctaatatctgttggactgccatgtcaaatgcttgcttcttcgctgaatccctgcccatcgtctgattcatcatttgacttttttcaattctttcctgattctctttataatatttgatcaggtccattcctatatattcttcacatgaccgacagctattctccatctcctcttgcgtaacttcccatacatctacaactctatgatcatccttgctgactgccaacattaatgttacgggttccgtaaatgcattcgtctgtgcataacccatagagatcactgattctctctcatattgtcctttaaatactttgtatacttcggatgtgtattttgaccgttgattttgtttataagaataacaaataaatactattatacaaaatacaattccgattcctacagccagaattaacattttattcttgtatgatgtttttatggaaacgaaaacatcatatttcctttctttttaatttgtgatgctaagaatcattatacaacgattctttttttgtagcaaccagaaagaaaccggctttgccatactttcttatatcatagagagttccatcggaatttcctgctatattatgttaaaaaaagatatcagctgatcctaaaaccagctgatatctttatcttctatatcttctatcagaaattattctatcctcttgtcttaccacccgcaacgttaaccgtcacaccatgtacgtaagaagatctcttgcttgcaagatatacacacagatctgcaacttcagaaagctttccagaacgtcctagtggaattgtggatgttttggaatatcctgctcttaactgttctactgtgatccctcttgtataagccagagctgtttcataaccgatcgtacgaagtcctgtagcttccatgattccaggtgctactccgacaacgcgaactccctgttttcctaattcttttgcccatgatcttgttaaagagtttactgcattctttgtagctgcgtaaacactctgtccttcggatccttccagaccactttcagaagacatgttgataatgacaccttcacctttttcaaccaagatccttccaactgcctgcgcacagaagaaaacaccttttagatttacattgcatactttatcccatactgcctcatctaattcatattgtccttttggatcctttggatcaactaacagacgtggaatattgattcctgcattattcactagtacatcaattgttccgaatgtttctattgtttttgctaccatagcttcaacatcagaaacttttgttacatctgttcttacatataataactggccttcttttgcatccatctctggtgcattctctgccatatcagaaataactacattcgccccaatattcaaaaactcctgcgcaacttccttcccgattccggatgctgcgcctgtgacgatgactgtcttcccttctaattctaaccaatcgttattcatcgttatgatctccttttataatttttcttctgcaacagactgctcgtgttgtgccacattctcaaatgaatcccattttgtggagaacagtaataagaacagtgtgtcgattactgacatcgctgccattcttgtgaaactaacctgatcatggaaaatgtgttctcttgttgctgtcagcaaaacatgatcacataactctgcaagtggcgatttggattgattggtgatcgcaattgttgttacaccattatctttcacgatctctaccatcttcacaagtcttttggatgccccagaggcagaaatcgcaaaaaatacatcaccttttctcaaagttctggaaaatgcttcctgactctcccaaattgttgaactaactgctttcaatcctaactgattgaacttgtaagatccatccagtgcaatcgggatcgtatctcccatcgcagcgaattcaatcagattggcatgtataatcaaatccacgatctctcttaattcttctggattaaaattgtgaaacgtcgctttgatctcttccactttactgatcatgatattattgagtgatttgtccatctgatcgatatcgatctcgttcgatatcacctgttcttcctgctgtcgttgttctccggccagcttgatcttcaactgatgaaatcccttacacccgatcttcttacaaaaacggatgatcgttgcctggctcgcatcacagtgagatgcaagttctgatacagacatctcgatcgcttcagatggatgactgatcagataatcggctactttcttctctgcatcatataaactatcatatgttgaaaaaatctggtctctaactaagatatcactactcatactactcccttctaaatctcaggagcattctgtatgaaatacctttctgcctctgcgctccataaattaccattgcgttctacgattgattttaattctctgatatactcatcatcgctgttttcatcgaatttgtcaacctctgttaatggaaattttttgtgcgtatagacaatttttttacttccttcaagttctggtaacgcctttgttgtttcaaccgcatggtcaagccctaatatatgtgttgcgatctttgcaacattgactgtcttgctctcgatcagttcaatggattgtttcatatcttccgtatttccaccacttgttcccacaaaatgtgtagaattataatgaatattatagaaatttactctggatgaaaattcttgatcggcaggccctgagaagaaattcaaacatccatcgaatgctaacattttaactccgtatgttaccatttcttcatttggtgcaaagataaagacatcatcaaatcctttttctgaatatttacgtagctctttattgacatctgctatatctcttgtattgacgtatacaagatctacaccattcttctttgcttcttctactgtgtataaccttgctgccatatcaatcttcttctgtgttcttcctgtgacaaccagcgtctttggtttctttggtccatggattgcaaagtcgatcgctaaaaatcccattggccctgttgcaccgagaagtgcgatcgctccaccttctttaattcccatcacatgttcatatgaatacattttcttcatatgatactgtgcattaaatgcacctacgacacatgacagtggttcaacgagagatccttcaaagaaggaatctccgttgtattttaatagtgaaccattttccataacctgatcagaaaagatgatcgttgtggcatcccctcccatatgatggaaagaatatcctggggcatagcctctgatatctccaatgttaggctgaatgacaaatttgtcaccttcctgatactgatctttccattttttaccgacctttttgatcgttccacaaaattcgtgtcctaaaatgatcggattttcactgatatcatctggtacttttttgtgtttttgtgcctgggtgattgctttgtaactggacatacacaaactgtctgttacaacctctgccataatttcatcatcttgcatctctggcagttcaaattcatccagtcttaaatccatttctccgtaaagtcttactgcctttgttttcataactttccccctaacagattatgccaaaattcctaatccatatccaacaattcctactgcaaataagataaagataattgcgatcggactgatgtttttctttaataatttagatacgaccaaggttaaaactaatgctaataatcctggtaataactgatctaagatattctgtactgttgttactgttgtttttccgtttgttgttactctagatactacaagtggtacgttaatcgtcgtccatttagataccagtgcacccatgacgaacagtccaaggatagaagctccttctgtgactttctgtaacatatttcctgctaaatgttttacaaagtctaatccttttttgtatccgaattcaagtccaaagtaaagtgctgccatacgtacgatgttgaatgctaagaagaataatactggtcctaatgcacttcctgttaatgctaaggatgcaccaatcgctgctgtgattggtcttaatgttccccagaagattggatcaccaactccacagaaaggtcccattaacccaatcttgatacttccgatcgttccttcatcgatatctgctccatttgcttttgcttcttccatcgctgctgttacacctaagactggtcctacagctgctggtgttacgttgaagaatgtcagatgtctctttaatgctgctacttgttcttcttttgtatcatataatcttttaatagctggtaccatgtcgaagcacatacctaatgcatgcattctttcgtagttaaatgatgcttgctgaaggtttgttctcatgaacatattaaatctatcgccttttgttaatttcttttcactcatctttaaattcctcctctttcttagtcaagttcgtcgtctagatcatcatccagatcatcgctgccacctgcacctgctgttactggtgctgccactggtgtctggaatttaggatttaactgtacatatacgattgcgaataccgcacccatgattccgaatgcaactaagttaaattctgtaaacgctgcaattacgaatccaaggaagaaaaatggcattaagtattttgcacccatcatgtttaataccattgcgtaacctacgactacgatcattccacctgcaactgttaatccaccagttactactttcggaatgctgtttaataatgtctgtacaccttctgggcttacaactgctgctactaagaatgtagggatcgctacacgaagtgcctgtacgaccaatgcagctacatgacagatatcaagcatcttgaagtttgcatcttctgcatatttgtcagctgcgtgctggaagaagattgttactgtacgagcaaatactgttaacacctgacctgcaactgcaactggaagtgcgatcgcgataccatttgctacagactgatgtcctacaactacaagaatcgtagaaatgatacttgctaatgctgagtcaggagactgtgctgctccgatgttcatccatccaagagcgatcatttccagtgtacctccaagtaagatacctgtttttacatctcctaagatcaatccaacaactgtacatgcgatcagtggacgatgtgtctggaaggaatcaagcacgcttcccattccagcgatacatccaaaaacaactaataaaacgatttgaactgtagatattcccatttttaaatcctcctttgtatctctcttatccttcgatgccttcgatcttgctcataagatctacttttttgtctgtggctaccggacggatctctaattcaattcccatctcatgcagtttcttaaatgctgcgatatcgctttcatcaacagatactgcctttgtgatctgagtctttcctgtcttgaatgccattcctccgatgttaacactcttgatcggaacccctgcttctgccattcgcagaacatcctgtggacatgtatataagaagaatactgtgtccttttcatattttggattgttgtaaacacgaactgcttttgctacgtctacaacgcttacttttactcctggaggtcccacctgtaaaagtaatgttttacggatctggtcttttgctacttcatcactgcaaatgatgattcgctgtgcgtttgcttctttggaccaaacggttgcgacctgtccatggatcagtctgtcatcgattcttactaaattgattttcatagttcatcatcctccatttcatcttcgtttgtattaccaagcaatttcttgcatgatttcacataatctcctgaaagtttgtcatatacttcgccagccttgatatcttcttccattgttctgattcctacaacatcgatcagcattggtaagctcaatcctgtaataacatccattcgatcttgtccgatcacggtctcaaatgctgcattataaggacttcctccaaataaatctacaaggaataaaatttcttcgtcttccttatagccatcgatcaattctttgtatctggcttttaatgtctctgcattctcacctggaacaaatgttacgatgtcaagatcatcaattgctccgaacaccattcccgcagaattcacaacctcttttgccaacattccatgggctgatacaattaacttcattgctctccctcctttagcacgaaatttatttttttacttttgtctcatgtgaaattttattttgtatcttgattatagtcataaacctaaatttcgtcaacttatttttcgtaaaattttattttttgtataaagtcatgatttttgctttctatttttgtatattttgcacaattttcaattgatcttttctgtttctgcacaaaaaaagaaggactttcgtccttcttaactcttatcataaaattgccacgaaattatcgtgtctccaaaaatgtcagctctttcttgccattcgcatcctttggataggcttttacataagcttttgcataacgatatgctgtattgaaatcaaacatggattcatacgcactgatccttgcgaataaaacttccttcttattctcaagctccttctgttttaatgctctctcgatcacttttagcccttgtgtatacttctcctgctttgctaacaccgcatattttgtacaatagatttctccatcgtctggatgctcttttattccctgatcacatacatctattgctttgtttagcttcttctgctgggcaaggcaatatgctttcaaagaatatgcccggctttctccatgatcgatcagctcatcatagatctctatggctttcccatactctcccatctgataaagagcctctccttcgtagaataaaacatctttcttttgctttgtgaaaatgagagtgaatttccctgctgcatggtcaaattgttcgtatgctttctgatattctttcttatcaagatatgtaattccttcgcttgctgtcattctttggctgatatatccaaatccgcaaaaagcagccagcgcgatcaggacaactataactgctgtaatgattccttttcctttactgttcataatctttctcctgctttgcatttttaattcttctgcctcttagtataacaaattctcttttcgcatacaagctaagccttcttatatctttcttcccttattttgtaatatagaatccagaactctttcgctgtgtgatatttccacatttatcgataaatcttgcgtagatactcacttttttgttcttctttttgtaggttatcttattcgccgttttccatcgatatttggatgcttttttgcctttgggcacgatcttatattgtgtctttgatttcccgctgattccataggatgctgaaaatacaaatttggctgactttttgatttttttattgtaagacgtttttgttgacgttttcaacgtcttgatccctgatcggttaaccttgatcttcgtctttgttggtgcttttttatctactgcaattcctggaagctgcatctcatctatccctgcatctgtgacaaacctcacatagactctgcctatcataccatctttaatcgttaatgttgtaccgtttttgtatggcacacttcctttggaagttccttttttcacaaatttgtactgaatctgttttatatttgtgaagctttttgcctgtgctgaaatcctgatcttgatgttttttctctcataatgctgatatgctgcagaggcttcagaacgaagtggtgtcattttcttctttgtatttgcctgcactgtaactttctgcatcaatggggtacgcttctgtttcactacatagcccgcatgacttggtacattgccgcctttttgtgctgacacacttagattcttaccatcagacgatactacgatcgttcctttatctgatgtctgataaacatccattcctgacagatcacgaagtacattgctctctggtgtctggtttacatttttatatccattactgatgatcgcaatacttgcacctgttcgatcgatcagatacttatgatccgaatcgtatacataacgacctttcggtttatcctgcaaacgaacatcctgatatccatgatgtggctgctttaatacctgtgcacttaaatcgtaacctctggctgcaatctttttgatcgtttcctgctgtgcatcgcctgtcattaaaaatgaattactgccataaacgatcctcgtcactattgaatatttatttacctgtcttgtatttaaattaggtgcatcctgtgctcttccatacctataggtattgtctaacggaccataaaaagtcattaccgcttcccctaattttatggatgttccggcctgtggcacaacatattggatatgcaatgatgcgtcttgatatgaattcctcttctctagtttcttcttaaatgtctgatacgtctgtgtatcaaatgctgtccatcgagctgtttcttctgtttgcttttctttatcttcgctgctttccagatattcaaactctaatggatttccataaatcgtatcgatcgtaatattcttatcttctagtatctttttcattccaccgatatgatctccatgtggatgagtaagaacaacaaattccagatgctttactccatgatccagtaaatactggtgcacacggtctgatacatcgattgtatcgtgatctgttgtctcataagaataagccccagaatcaaccagagcatacttcgcgttttctccttctccatattgaagcaaagctccatcggcggcccctacgtcaataaaatgaatcttaaatgtctgtgctgcattaactttgattatttgacctcccgatacgtgcaaaacagtgatgcctgtaagcatcactgtcagcagtaccgctatgatcttctttgtaaaatatttcatacttccatcctagcgttttctttgttatttcttagttacgtaaaatccgtttgtcttctttgttgtgatatttccagatttatcaatatatcttacatataaacgaacttttttatttcttttcttataagttacactatttgctgttttccatttgtacttggaagctttttttcctcttggtacaaacttatactgtgtcatggattttccactggttccataatttgcactaaatgtaaatttgacagacttcttgattcgtttactgtaagtattctttgcagatgttgacagtgttttgatccctgacttattcgctttgatcttcacactggttggtgctttcgtatcaactgtaaatccaggaagtttgatctctgttgatcctaatggtgtattatatcttacataaaaccttccacaatttccatttttgactgtataggaacttcctgtcttatatgctatggttttattattcacaccttttggcacaaacttatattcaatgcttgtcaactttgtaaatccttgagctgctcctgaaaatcttacagtgatattcttcttttcataacgatcataagtattcgcagcatccacactcgttgctgtcaatggctttgttgtgtttgctgtgatattcatggatttcatcactggagatgatgtttcatcatcactttcttttcctttgacacttggctggttatctcctttctctgtctggatagataactgtgagccatcggatgttacaatgatcgttccacggtctcctgtctcatagacatctaattttgataagtctcttaagacttttgtatatggaacaccacctgtattcatgtatccattactgatgatcgcaatactagcctgtgatgcatcgatcactgttttatgatcagaatactggtagccattggctaactcttcttctgtgacatcctgaaatccatgatgtggctccttgagcacctgtgctgtcagatcatatcccttcgcgatgatcttctcgatcgtttctttctgggcatctccggtcattaagaaagagttgcttccgtaaacgatctttgtaacgatagaatatttattttcctgtcttgtattcaaatcaaccgttctaccatattgataatcattctctaatggaccatagaatgtcatttttgcttctccaagactaattgtttctcctgcagttggcactacataatctacttttagattttctttctctgttttgtcttctgcttcttcggcaagtttatttcttgcttctaaagctgctttaaagttcttgtatattttggtatcaaattctgtccaatttgtttcatctgaagactgcttgctcttatcctcgctgcttttcaagtactgaatattcagatcattcccataaatcttatcgatcttgatcgttgtatcagaaagaatcttttccatacctccgatatgatcctgatgaggatgtgtcagaagtataaattccagatgttttactcccatcttatttaaatattcatagactggtgtctttgttgtgtcaatcgtcgtatcctttgtattatgatactggttggctcctgtatcgatcaatgcatactttgcttctgttccttctccatactgtaataatgcagcatctgcacatccgacatcaataaaatgaatcttaaatgtctgtgctgcttttgccgtatgcattccatgcccagttacaactgttgtacagaccaatatccatgccagaaagcacactgcaagtttccttataatgttcctcatttgttactccctttctttgtttttcatctttattcttgatatttcttttttacattcgaattttaacatattcttaatatttttgcaatttttttgaaatattttatcatctgtttttacatgaacagaggaagagtccctgctttgggaactcttcctcttaacttatcatattcaatactatatttcaagactatatatatgactatctgatcttatctaagtgccagatatcatcgacatattcctgaattgtacggtcagatgagaacttgccacatcctgctgtgttggtcatcgccatcttagcccatccttttgtatctctatatgcttcttctactttcttctgagcttctgcatatgaacggaagtcttttaagatgaagtacatatctgcctggcttcctgtatcaccaaataacagactctggtacagatctttgtaaagttctggatcaccatttgcatatgttccatctactaactgatctaagacttcatggatgtctttatcattctggtaaatctcatatggatgatatccaccgttattctcataattgataacttcttctgagctcataccgaagataaatgcattctcagctccaacttcatcaacgatctctacattcgctccatccattgttccaagtgttggtgcaccatttaacatgaacttcatgttacctgttcctgatgcttctttggatgctgttgaaatctgttcgctgacatctgctgccgcaaagatccattctgcattggatacacgataatcttcaataaatacaacctttaacttacctttgatggacgcatcattatttactttatcagctacagagttgatcagtttgatcgtctgttttgcacgaaggtatccagctgctgccttagcaccaaaaataaatgttcttggatagaacttcatatttggattcttctttaactgattatacagatacatcacatgtaaaatattcatcagctgacgtttgtattcatgaagtcgttttacctgtacatcaaagatggatgttggatcaacttctacgccattgtgttctaagatatattttgcaagacgttttttattctgcagtttgatatccataaattctttctgagcttttggatcatccacatatttcttcagtcctgacattaaagaaaggtctgttgcccatgtgtctgttccaagtttctttgttacccaatctgcaagtaatgggtttccatgcattaagaaacgtctctgtgtgattccatttgtcttgttgttgaatttctctggcatcatctgatagaaatcttttaattcctgattctttaagatttctgtatgaagttttgcaacaccattgacagaatatcctgctgcgatcgccatatgtgccatacgtacctgtccatcccaaaggatcgccatcttcttgactttctcttcgtttcctggatacatctcacggatcttgtttacgaaacgacggtcgatttcttctacgatctggtatactctaggaagtaattttgagaataagtcgattggccatttctctaacgcttctgccatgatcgtatgatttgtgtatgcacaagtctttgttgtaacttcccatgcttcatcccatccaagaccttcttcatccattaagattctcataagttctgcaacagatactgttggatgagtatcgttcatctggatcgtcatcttctcgtaaagttttgtaatgtcatcgtggtttttcttatatttggccactgctgcctgtaaacttgcagatacaaagaaatactgctgttttaaacgaagctcttttccttcgtagtgattatcgtttggatataatacttctacgatgttctttgcaaggttcttctgttctactgctttgtcatattcacctttatcaaaagaatccagctggaagtcagtgatcgcttctgcatcccagatccttaatgtattaacgatatgatttccatatcctacgatcggatagtcaaatgggactgccataactgactgatagttctcctgaatgaagttggttcttccagttgcttcatcatattctgtacggatatttccaccgaaacgtacttctttggcatattccggacgttttaattcaaatggatttccattctttaaccattcatctggtacttctatctgatatccgtctttgatcttctgtttgaacattccgtattgatagcggattccacatccataggctgcatatccaagtgttgccaatgaatcaaggaaacatgctgctaatcttccaagaccaccattaccaagtgctgggtctggttcctggtcttcaacggcattcagatctacgcctaattcatcgagtgcttctttcacttctccatacatactcatattaatgaggttatttccaagtgctcttcccatcaggaattccatggacatataatataaaatctttgggtctttctcttcgtaggtcttctgagtatccatccagtcctcaatgatccactcttttagggcataagccacagcctgataaatctgctgctgggatgcattattaagctcaactctgaactgagtctttagattattgagtacttcctgtttaaacagtttcttatcaaatctttctgttttcatgattgtctcttcccctttcgtattcccagtgtgttattaattttatcatataaattggaaatacgatacaaaaattacaaatatcatttgtattttttttcgtaagttcttctatttatacaaactagctgccacgcataattttccatatccaatttcattgtttggatagtccaaaaatccattcattttccttgcacctttatgaaaataagctttgatccgctctccatacaaataaggatcattttttcttatgatcccccattccatcaaaagagctgccgctcctgtgacaaatggcgttgccattgacgtcccggacaaactgttttcaccgcctcccggtgctgctgccaaaattccaactccaggtgccacaagatctggtttctttacaccatatctttgatcaccccgccccgaaaaatctgcataggactgatatctgacatcatacgcacctgctgagatcacattttctgcagttgatgggattgttaaagtaaactctttatctggctctaaaaatctagtttcctgattacttcctaaggataccggaagccacatctgatattccccatttctgatatttcgtggaatcaatgtaagattccattgtccactctctatatgattcccttcctgcacaataaaactaaggaatatttcctgccttacattgtacggtgttggataaccattgtatacaaacacgatcgtatttccatatgaatattgtgactttccctgttgatctgtgatctcataagatattcccgatggagattccagctgtattcttaactcatccacaaaatctttccatatctggagatttagattctgctcaaatggtgcaatatccaataagattttttgttcttccttaatcagctttccttgtttatgctttccactatttccctcatttcctgttccaatgcagatcgtacatttccattgctgtgcaatctgtgatataaatctttctaacaaggaatttcctctatgatctccataattatgtccataactgatattgaccgcaaccggccgtcctgcctgtgatgcttcattgatcacatattgtaatgctgtcatcaattgtgtcgtccttgggaaacctttttctctcgtatctcccaatttcacaacgatcagttctgcctctggtgcaaccccatttatcccagcacagattgaggctacatgtgttccatgcccagattgatctctgctccgaaaatcgtatcttccactttctgaatgcaatactttattgatttcttcttttgtatagagatttccgttaagaaatggtttaggcggacttcctttgaccgtttgatcccatagtgcataaatcttagtatctccattttcatctataaaatctgggtgaaaaatatcaatccctgtatcgatcacagcgacaaaaacacctcttccagtcaatgaaagaggtggattcttgaccgacaacatacaagatgcggctatcgatggctgtcggcttaataatagatttttcggtttttctatataaataacttgttcatttgccccaaatgcttccaactcgtcttcttttatataggcgatcgcataacccatgctcaacggttcgatcctcgttgtgtctgaccatctgatcgtatcaagtgtgcctgcgtagcgaaatatgatctcccactgatctgtttctttatcgtatcctgcatctaaatctttggatttctcccgttcttcttcgctaagatccagagctagatttaattgattttcaaacttttcatcctgttccatacgctatctgtacactttcgtttttcttatcttatgcaaaatctgtgggttttattctcagattgctcatatctcttttttgcagtatttccatacggatgcacaaattccgtaaacagaagatgctgtcatgattcctgccgcaaccgccactgcgatcagcaatgttttttgcccatataaataaaataaatgccactgttttgctaatacataattcatcgtatagtataaatttccacctggcactaatggaatgattcccgtaatcaaaaatactgtcacaggagtctttaagatccttgccattgtttctgcatagatcgtcgcaactgcggccgctgccaggttcgccacaaatgtacttggcatctcattccacgcgataaggtaggcgatccatgataccatcccagaaatcccagccatacaaagtttcttccctcgaaggttataaagtactgcaaatccaaaacttccaacaaaacttgccagtacctgtatgatctctgctttcatttataatacacctcctaagaacatcaatgccataaaagaacctgctgcaaggaatacagctaacagtatcgattcacagactcttaagattcctgacatcatgtctccaccgatcatatcccgaagtgcattaacaaatgcaactccaggaaccaacagcatgatattaccgatgatgatctttccataatcctccgtcagtccgaattttgcactgatatatgcaaatgctgcaacaaaaaatgataatagaaagtttaataccatttcgttgggtgctaagatcttaatatatcttgcaaggaccgtgacaaatccccctgcgatcattgctatgattccttctgtaatgccacctccataaaatgaagtccatgctgctgcaatgaccgctgatgtaagaacttcctctgtaaaaacgacgaattttccctttttgatctctgtgatctttcgttttacttcctcttcttccggaagttctctgcacatatatcttgataactgatttaactcatccagtttggtaaagtctgtcttatatgacctgatacgctttgtctgcgttaagatttctcctttttcatcttcgatcgttgttacaatacttgatgtgatagaaaatacattggcttcttttgctccatacgccttgcagattcttgaaatcgtatcttctacccttgaaacacctgctcctgacactagcatgcattctccgatctccattgcgtattttaatacttttttcatttccataacatctatctcctgctatctattgtatcgaaattgactgtattgtaacacaaaagaaacccttgtgctatgatcacacaaggatttcatgtaaaattcattatttatttacatttcttttaaatgacaagaaaatgtactatatttattattactcatcaatcttatgtgtccaagcaaccgccaatgcacctgcaccgatatgacatgcaacacttaaagataatggatcttgatggaattccattcctgggaattctgccatcagttcttctttccatttaagcgctgcctcttcatcttttgtatatgcagattgaagatatgcgtgtttaccaaaatctccatctgggaaacgctcttctagctcttttcttattgctgtgatcatctttttctttgcctgtttgacacctcttgtcttcgcaaatgcatccagcttctcgccatggatctgtaaaactggtttgattccaagcactgtaccgatggctgctcctgctgctgtaacacgtccgcctttcttcagatactttaacgtatctaccatgatatagattccagaatctaatttgtctgcttctaagatgtctttgatctctttggctgactttccttcttccactaatttggccgcatctaagacagactgtctctgtgtgacagaaatcctctggttatctacaacctgaacttttccatcgtaatcatctgctaacattgccgctgtcgcacaggaactgcttaatccactggacatcgcgatgtgcacgatctcatcatggtcttctaataacttctcccacagatccaacacatctccaggtgcaggctgagatgttttgatatcttcatcttcatttaatttctgataaaattcatcctgtgttaatgtaatatcttcaaaatataattcttcgttaatataaaatggcattggaatcactgagattcctaattctttaccttctttttgagtaattccgctgttactatctgttacgatcgcaatcttgctcattcttctaatccctttctttaaatttcctatcaatatatctattttttgcctttacctcacatcataacagagattcatagatatcgtcaaaggttttcccctcatattttgaaaaaatacataactattttgtgatttcctgcaaaaatcttgcaattggaaatcctacaacattgtagtaatctccttcgatccctttgataaagacagctgcttttccttgaatcccataagatccagccttatccataggttctccagtcttgatataacgatcgatctgctcatcactgatctcataaaatgtaacttttgtttcttcataaaatgtttttgtttttccatcttcgatgacgcaaactcctgtatacacttcatgtgtctgtccgcttaacatcgtaagcattctttttgcgtccgcttcgtctgctggttttccaagaatctgcccctgataggctacaacagtatctgctcccacgaccatactttgtttctctgatttcttatatatgtctttcgctttgatcgatgctaattccataactacttcatttggcgctgtttttgttgtgatctcttgtgcatcgcttggcataacatcaaatttcagatcggcaagttccaggatttcttttcttcttggggaagcagatgctaatataatatgtttcatttgttttatacctcttattttacttaagttatcaaattctcctgtgaattacccctcccatgcggtacagtagttcctatggaagtggcttctaacagtcgtgacagttacccattcctgaccaaaagattggctgtccgtaccaatcaaggcatattcacttatgccgctatccctttgacgggaatacctttcagattcagtttgtggaatccatacacatcaggagcagaaagaaacgtataatctctggtatctttccagatatcagggatcgctttccgcatgatatttgctgctgcgtgacaatccgcatttaagatcattccgttagagcaacggtataaaccacgtttgatcctctttccagaaaacgaagcatccttatcatcgacaccataggttgggatcctgtcatttgcgatcagatccgctttggaagtataactttcttcctgctctatgattctgatgccggcattcagagctttatatgtgatcattgtccgcaggagagtgatcggcatggagacaaaattctggttgttgatcttattcatattggatttctgcttccagagcagattcacaccaaggatcagtgttccatacagaagtcaatgatactacgactgatcttgtggcactggtctttcataaaattggcataatggaaagaaaggtctcttaaccgcttggaaacagcgtgtttcttttcatgaccttttgtgatgatggagacatactttgctctctgtttatgaaaccattggatcttggataagacagctccgcctttgtatattgcggatgagtgatcatcacatacgatcgctgcgaagttatctgttccaagatcaatggcacatacatgagatccggaaggatcaaatgcaacatctggttcttccagtgtcagacagagtaaaaaacgaccataatacggtttgatcttgacttcttttaatacatgatccgaagaaagatttgaaaagtacaaacgtttcttttgcaaaggcagttttaaggacatccccatatcgtcccgatacaaggcagcatcctggtttgtgatgatcacagtcgtcaggtcacttttcttatagcgaggcatcttaggcttacccagatacttttctggatgctttttatattctcttaaagaaacaagccagtttttgaaatctgtgactgactgtttgaccatctgctgtgctgtctgtcttggaagtccggaaaagaaatctgcattctctgtgacacgcatcatcttttcaaggtgtgtataagagatcactctgcggacgtgcatgtttggataagatcgttgtaataacgcaacttcttgaaagacttcgacttcgttctctgtccgatgttctttgtcataaccggtaaagatattccgcacacgaaaaagagctgcattgtacaacagcttggactttctgcacagatcgtcaaaatatggatataacagatcatccgaagaaatgattctttgtgtcacacggtatgccatatggttgtctcctttctgatatgttgaaaatatcgtacttttatagtataattataccaaacatatgtttagctgtaaaagagatacgtcatgtgaaagaaagataatacagattattatataaaccggcatagttgctttttattgcaataccatatcgtgtttgttacaaaatacagacatccagtcttaacagacaaagtaaaagatgttgtttatgaacgtatccactatgtagcagatcaaagagggtttcacatcctagagatcaatggcgaatcggatcatgtccatatcctgatggaagctgatacaacaacttcaccggcggaacttgcaaatgttttaaaaacacaaacagcacgaaagttgtatggcgaaaccattttaaaaaaatattactggaaaccttatttttggtcggatagttattttatttcatctgttagtgaaaacagtctgcacacaataaaacagtatattcggaatcaggggaaacgataatgtgtccgtcaggacgcattcacccacgcccatattaaaatatggacgtggtactctgcttagattttatagaacaaaaaagcagcttttcatacactttcgcatacaaaaagctgttttgtcattcttaattaatcttcaatcttttcttctaatttcagattgattcttcccatcttgtcgatttctaatactttgacagctactttgtctccgatattcacgacatcttctactttctcaactctttcattagaaagttttgaaatgtggatcattccgtctttgtttggagaaagctgtacaaatgcaccgaagttcatgatccttacaacttcaccttcgtaaatatctccaacattcaatggttctacgatggatttgatgatgctgatcgctttatcgatcattgcctgatcttcacttaagatatcgatacgtccgctttcgtcaatatcgatcttaacacctgtttcatcaatgattccattaatcgttttaccctgtttaccgataacttctgaaatcttctcaggatcgatcgtatactgagagatctttggagcaaattctccgacgtggtctcttgcagctgggatcactggattcataacatcatgaaggatatgtgttcttgcttcttttgttcttgcaatcgcttctcggatgatctgttctgtcaatccatgaatcttgatatccatctggatcgctgtgatacctttgtctgtacctgctactttaaagtccatatctccaaagaagtcttctagtccctgaatatctgttaagatgatgtaatcgtcatctccttctcctgttacaagtccaacagagatacctgcaactggagctttcactggaacacctgctgccattaatgacagagatgaagcacagatacttccctgagatgtagatccgttagattccatgatctctgatactgtacggatcgcatatgggaattcttcttcacttggtaatactggaactaacgcacgctctgctaatgcaccatgtccgatctcacgacgtcctggtcctctgcttggtcttgtttctcctacagagtaagaagggaagttatagtgatgcatataacgttttgttgtttctgttacatcgattccatcaagacgctgtgcttcagataatgatccaagtgttgtcactgtcataacctgagtctgtcctctctggaataatgcagatccatgaactcttggcaggcagtcaacttctgcgtgaagtggacggatctgtttgatatcacgaccatctggacgtttgtgatcttttaagatcatcttacggacagtcttcttctggaatgcataaacagcttcaccgatctgtgctaaccattcttcattctcagcatatctttcttctaatttttcttcgatcgcacggatatttgcttctcttgtctgtttgtcatctgtaaatacagcttcttccattgcttctggagtaatgaaagctaccatatcatcatacatctctggatctacgatatgatgctcgtagtcatgtttttcttttccacattcagctacaattgtatcaataaatttgatgatctcctgattcacttcgtgagctttgaagattgcttctaacatcacatcttctggtacttcattcgcaccagcttcgatcatgataactttttctcttgtagatgcaacagttaatgcaagatcagaaacttctttctgtgcagaagttgggttgatcacgaattctccatcgatcagtcctaccattgtagatgctgtaggcccgtcaaatgggatatctgaaattgctgttgcgatcgcagaaccaagcattgctgtaagttctgggctgcaatctggatctacagacataactaagttgtttaatgcaacgtcatttctgtagtcttttggaaacagtggtctcattgggcggtcgatcacacggtctgtaagaattgcattctcagaaggttttccttctctctttaaatatccacctgggatcttacctactgcgtataatttctcttcatattctacacttaatgggaaaaaatcaattccatctcttggcttttcagatgctgttgctgtagataatacaacagtatcaccgtagtgcataaatgctgcaccgtttgcctgtgctgcaacacgtccaacttctaccatcagtgtacgtcctgcaagttccatactaaactgttttgtcatagttcgtctcctttatattttttgtcttaaggcgccgaaacaactgaaaaaccgactacttgtcttccttcatgttgtaataagcttttcagcagtctcggaaaacgcctcagtaacctagttagtatagcatggtttgtttaaaaagaccagatgatttttattttattggcgatttcatcgaaatttcctatgcaataaaaaactgccgcatgacattccatgcggcagtttcaatatcttcattgataagattattttcttaatcctaatttttcgattaatgaacgatatctttcaacatctttgctctttaagtaagctaataagttacgtctcttaccaaccatcttaagaagtcctcttcttgaatgatgatcttttggatgctgattgaagtgatcctgaagttcgttgattctagctgttaagattgctacctgaacctctggtgaacctgtatcttttgcgtctttaccgtatttagctacgatttctgctttcttttctgatgaaatcattgtgttttcctccttaaaattcttatatcgcctgataccaggaaagggttggagtgcccaaatctgagtatcggtttcactaacttttatagaatatcataggtttctatgatttgtaaagaacttttttatttttctttcttttttcctaattgatggtttttctttgctgctgcagtcacagcttcgatcactgcacttctcattccttttttctcaagaacgttaaccgcttcgattgttgttcctgctggagaacatacagcatcttttaattctcctggatgctgtcctgtctcaagaaccatctttgcacttcctagcaatgtctgtgcagcgaatgtatatgcctgctttcttggcagtccctgtgcaactgctgcatccgccattgcctcaataaacatataaacataagctggaccacttccactgactccaacaacggcatccattagattctctgtgatcttttccgcttttccaaaactttcaaaaatcttatgtaccaggtcaaactcttcttccgttacatattcattacagcatagtcctgacattccttctcctaccagagctggcgtatttggcatcacacgtacgatcttaacttcttttccaaattgacgctctgctgcttccatagaaacacctgctgcaatcgttacaatgatctgttctgagcttacttcatctctgatctctttgatcacagctgggtatacctgtggctttacagataacaccaaaatatctgattgttttgccacttctttgttgtctgttgttgtaatgattccaaattcatcttttagtttcgctgttttttcttctcgtggattggatacgatcaattcctgtggacttacgactttctgtgtcaaaattccagtgatcattgcttgtgccatatttccacatccgataaatccaagtttcattccgtttttcctcctatgattgttctaattatccagcttgttcagtaatttttcaaaatactctggcaaaggcacttcaaactccatatattctccagttcttggatgtacgaatccaaggaccttcgcatgaagacactgcccttccagtgtatactttgacttctttggtccatagacatcatctcctagcaatggatgcttgattgatgccatatgcacacgaatctgatgggtccttcctgtctctaattgacattcgatataagtaaaacctttctttagacgttttaataccttataatgcgtcactgcatgttttccatccatgacgattcccatcttcttgcggtcttttaagcttcttccgatcggtgcattgactgttccttcttcttccttgatatttccataaacgatcgcatgatattttcttgtgatcgaatgatcatataactgcttggcaatactttggtgtgccatatcgttcttacagacgatcaggatccctgttgtgtctttatcaatacgatgcacgattccaggccttaacactccgttaattcctgacagatcatccttacaatgtgccatcaatccattgaccagcgtaccactgtaatgtcctgctgccggatgcactaccatgcctttgggcttattgatcaaaataacatcctgatcttcatagacaatatcaagattcatctcctctggcaaaatctcaagttctgtcggttctggaacctgtaaggtgatcacatctccttctttacacttcttattgcctttggaagtcttgccatttaatgctgcacgttcttccttacacaatttattgatataacttctcgtaagatcgctgcactgctccgaaagcaccacatccagacgcttacctgccatttcacttgtcactttaatttctattgtctcgtccatgttttcctttcctgttaagaaaatcaagatcttcttccttatagaaaaataagatcaagatcaaaagtaatatcattgttacggtcacataaatatctgcaacattaaagactggaaaatcgatccatttaaaataaaagaaatcaaccacatatcccctgaatactctgtcgatcaaatttccaaacgctcctgccatgatcaatgcataactgatacgaagcggtatatatttcttcgtctgtggtattctccgatagatccatgttaagattactgcagaagctactgtgatcaatacaaagaaaatctgatgatcctgaaggattccaaaagccgcccctcgattctccagataagaaagttcaaatacattgggaatcacagcgatcccttctgtacctcgaagtgcagataatgcccagactttacttaactgatcgatcaagatcagccctatgatatatatataaatacgaatctgtttcttcatgtctcgtccttaaaaacttatccctgtaatacttgtttcatttcatcatccgtcacgctcatatcaatatatgcatctccgacagatcttaacaatacaaacttaatcttatctccgaccatcttcttatcggatttggttgtttttacaatatcatctgctgaaagttcactgatatctccattcatatcaaatgcttcaaaaacacctttgatatcatcaacttcttctttactgatatttccttttatacaagaaatctctactgccagacagcacccagctgccacacactctccatgaagccatgtaaaatcctttagtttctcgatcgcatgccctaaagtatgtccaaagtttaatagcgctctctcacccttttcctttggatcacgttctaccacaccgcctttgatcagacagctttgatagatcatttctttcactgcttcatgctctcttgccttgatcgcatctatattttctttgatccattcataataatcggcatctttgatcaatccgtgtttgatcacttctcccattccagagaaatattctctctctggcagagattttaaggttgttgtattgatgtatacaagttttggctgatggaaagccccaaccatgttcttatactgtaagaaatcaacaccagtctttccaccgatactgctgtcaacctgagatagaagtgttgttggaacctgtacaaaatcaatgcctcgaagatatgttgcagcagcatatcctgtcatatccccgacaactcctccacctagagcgatcaacagatcctgtcggtcaaaatgattgatgatcagttcttcatataatgcttcgatcgtctttaactgcttatgtttttccccggcttcaaaactgaatgtgattgttttggaagccttggatgagatcagttcacaaacttcttttaaatagattggtgcaacattgctttctgtcacaatgcagacttttttcttctcaatttcaaggaattccatctggtccaggaggtctgcaaaggaatctcttaatacgatatcatatgctttctttccttcattgcagatctcaatcttattgttcatttccaaattgtttttgctgttcatcttcttcatctccatctgtctgctcacatcctgcaatttcgaattccatctcataaacgggattatctaaaatatccatctgcccattgataaactgcttcattctggctttgtagctctgataatcactttccagtttacggatcagcttctgataattctcaatcgtcttttcatgctgttctttctcttctttaaagtcttccttcgcacttgttaagatcttctctgcctgatcctctgcctctgataccaactgttttgcattacgggatgcttctgcttctaatgcctgtgctttattgtttgcattctcaattgtctctttggatgtctcttccgcaagaaccaatgctctctttaaggattcttcgatcgtgcggtaatggcttaagttctctgtcaatgcagatactttctctcgcagttcgttgttttctttataaactttctcatagtctttcgctaattcttctaagaattcatcaacttcgactgctttgtagccaaatcctcttcttagttccttccctaatacctcaactggtgtaatcatatatccctcctattgaaagatcgccagtgtgataaactgacggcctttttttgatgtttttcctaaatcttccaccagaaacttcccatatccgcgcacggatatgatatcgccctgtttgatcttttgtccacctgataaacacatctttccattatgaaatactttctggctctttagcagcttctcactgatattcctggataaagaaaaagcctgtgaaaccagaacatccagcctcatggacgcaacaaatccttcttttttcttgtatttttggacatatccagtctcttcccatgaaacttcttccacaaaaactcgcgtatgccttacctgatcaagctgttctttgatcacacctatgatatgttccatacagaaaatataggcatatctcccatcgatcaggatatcaccgatcaaatgtctctcgatcccaaggttcatcaatgctccaagataatctctgtggcttaattcttctgcgaatttatcaaaaacaggtgagatcctggcacaaaccactggaacctcaccctgataaccaaataattcttctgagccaaacatcaccactgcccttgtaaaatacttatgccctccaacaagtattggatgtgcataagcaagttcttgcttcatatcctgatagatactctgttcatattcattcagaaagtgtgtatatgtatagatattctgattatatgctttctcacataattccatcagacgtttctttaataactcttcttccttcatgatcttttattttaactgtggtgagatcgtattctcattcatgatctcgctttttaaatctccactgacttcaatactgtctggtgctgcaataaaaatattgtttgatactgcctgtaaggatccattgatcgcataagttgctccgcccacaaaatcaatacttctctgtgcaactgtaagttctacaccttccagattgatcacaactgttcttccttcttttaaaagatctgctgccgtctgtgcttctgcaaaatcctgtggctttattacataaacttccacgcctcttccattcatagatacgaccttgcttcctgtacttgtaaatcttcgtttctttgcttctctgcttgctgtaattgtattatcaaacggctgacttatcttgctgttactgctttcttcttctacttcaggctctttcttcttaaagaaggagaaagtacttcttggttcttcctcttcttcctcatcgtcttcgtactcttcatattcttcatcgtactcttcatcgtctgatagtttcataaagttcagcagtttgtcaactgtacctttcatagatcttcctccactaaatattatagtttctctctccaaagattgccgttccaactcttaccattgtcgcaccttcttctactgcgatctcataatcattggtcattcccatggaaagtatactcatatctacattatcgaagtttttgttgttgatgtcaacagataattgcttcatcgcacggaaatacttacgattgtcttctggatcatcaacaaatggtgcaatctgcattaaccctttgatctttacatgttctaaggcagaaatctctttcaccacatcaaaaacatcttctggattcaatccaaatttggtatcttcgtgtgcaaaattcacctggatcagaattggaacttctttgacatcatgctttgcagcttctttgtcgatcgcctgtgcaagttttatggaatctacagaatggatcaatgctactttatccacgatatatttaattttattggtctgaagatgtccgatcagatgccatcttaccggccaactgatatttgcatatttatctctgatctcctgtaccttattctctccaaaatcaagtactttttcttttcttaattcttctaccatttctaatggtttggtcttgctgactgcgatcactgtcacttctcgtggatcacgtcctacacgtttacaagcttcttctacatgtttctttacttcattatagcgttcgatcaacatatccaattccttctttctgtaattcttataaatttatatgccttaatatatgatctggttttccttgatcgttgttccatcaagaacaatgaaatcataccgactaactccctgattggtatcatttgcaatgatcgaataatcatctttctcgatcagaatatcgatcggacggaaatccgcatatccctgatttgtacaataaactccttttaatgtcttcattttctcaatcaaaaatgtatctttggaatccattgcctgaagcactacgttctctccaacttcttctggatcaagataacagtaatccttcgttcttccatagatcgtaaagctcttttgttccaccgtcacatcgcctttgttgcttgtatcacgtacggtaaactgttctttcgcactgttatctccttttgtaaggtattttactggaacctggtagaatttcttctttacaatggatgtgtttggaatctttaatcccttgtaggaatcaagcgtcacatcgatttctaagtagcgctcattgatataacgtaccgcgtaatcattaaacttaagatatccaaaatacgaacttccctttttggcgacttccaccattgctgtggctgttgtctgatcttgcaggaaacgaaccgacacttcacttttatccttcaacatccgatactgatctgcttctagtggaattacgatctgccatttttcgcttttgttgatcctagctacaactttgcctttctttactttatcggacgtattatacctctgaacacgatactgactttggtcaaaatccttgcttgtgatatcttttgcgttcttaccgtcaaagtcatcagaataaaattgtgttaccccactacttgtacttttctgtgtctcaaaacttgtatccccaagcttttgtttgactgcttctataactgttttcatagaatcttcacttaagttgaggattgcattcttgagatcatatttcagatcataaaccgtgctgaacttatgatcactatatacagactgataatctgtgatcttatgctgaatctcttcatcatcgatcacttttttatttttctcaagctgctgcacctgacttacaaatgcatcctgaaccttctgatctttatcaaccgtaaagaccgttcctgatttcttgatccgttttccttcttctacataataggtaatataaccgctttgtgaagcctttagaagttcctcatcacgaatcgcaattcctgtaaacgataaggtattggtgatcttatcttccgttaccttgtagacagtcagctttttcttgcctagaaacaggatgacattaatcaggatgtagaccaatatgactacaaaaatgatcattccaatattccaatgtatttttgtttttcgtcttcgttttgctgccatctcttaaatctcccatcgcctgagcgctgctccatttaaatagtcaaatttacatccttgcatataatcatttgtttccatgatctcgtcaaatcgatcttttaatttccaccagctgatgccccagttagaaaatgatgcatcttccttgggcactctgctgaatagacgctcgatcaccatatcttttcgtacataacagataaagtttaccagtctgtccagatattcttttggatcacaaagagttatttttccttctttatactcctcatacatttttgatcctttgggaatataaagagaatgtaattttacgatctgcactggaagtgcagaaagaatctttgctgtctcgatcacatccgtcatgtcatctcctggcagattcaaaataatatgagtgcagatctcaaatccatatggtgctgtcattaacacagcatctagatattctgccagtgtatgtcctcgattgatcttgtttaaagtcttataattgactgtctgaagtccatattccatagagatcttcacctgatattcttcagaaatcttctttaaacagtctaaatattccttcgtaatacagtcaggtcttgtggataccgaaattcctacaatatcttccgtctgtgctgcttctaccagatacttttcaaacttgtcaaccggcaggaatgtgttcgtataattctgaaaatatgcgataaatttctttgctttatagcgttttgtgatctttccttttgtcgcattcagctgttcacttacagatacctcactgttcatagcttcaaagccggttcccacacctccacagaaagtgcacccatctccatccatacggtttggacaagtcaccggaagattaactggtaatttatatactttttctccatataattcctttaaatgtgtgctgtaagctttgtatcgttccatcttagttttcctttgataatatatctgtcattgtatggtaaagagctgattttgtaacgccttttaacaccacggaaatgaattcctcaccgtctttattctttgtaagaagaatcaggcaagaacccgcctgtgttgttgtaccagtcttgcctccgatcatatatacctggcttggaagtgtgtatgttccagcaatatactgatttgtggaagccatatcataaatcttttgttctcccttggaaccaagatattcaatcctgctgcttgatcttcctgcaatattaaagaattcattatgtttagctacttctttaaagatcagataaagatcatacgctgtagaataatgatcacttaaatgaagtccattcggatttgcaaaatgtgtattggttgctccaagttctttggctctcttattcatcatttttacaaaatttgcttcacttccagccactgcctctccaagtgcaacggctgcatcattggctgacataatgatcaatgcatttaacaatgcttccactgtgatcttatcccctttcttcaggtggatcgccacagctgctccatcagggaacgtaatgtcatgtttgatcgttacaacctgacttaaatttaaattctccaaagtcagcaatgctgtcatgatctttgttgtacttgccgggtaagcctggtcaaaaaccttctgactaacgatcactttattctttgtattattaaccaacagaacttccttggcttctggatagtcgttattatccgccttttctttggatacaaccgctaccttagaacctctggattcccaacggtcactcaatgcatcttcttttaatgtcgtttcattcttctgataatgttcatcatatgatgtaaatccacctgtcttcgccgatgtctggcagccagataatgcgatcatcatgacggacatacaaatacaaattaattttttcattttatgctttctgtaaaaaaagaccgtcgtgtgacagtctatttatacatattcctccaatctaaatctcctcggtccagtgccaaaatcaatacttctgccgttggcagattcgtagcacacggaatattatactgatcacagagatttaaaacattataaaaatctggtgttctcttcttatttgccgggtcctgtaaaaagatcaagaggtctatttcattattggagatcttagatcccatttgctgcataccgccaaaatggccggcaagaagtttgtggatctttaagtttgcaacatcttcaatcatctgtccagtcgtacttgtagcatataatttatgtttttttaaaatatcctgatacgcgatacataaattctgcatcaggttctttttgccatcatgggcaactaatcctacattcatagatagaacctcctagtgtctttttctttgtaaatatatattaagtaccattcctatcgcgattgacgccgacattaaggaacttaatccataactgataaatggcaggggctgtccggtgttcggcatggttcctgtagcaactgcaatgttgataaaagactgaaatcccatataacacgcaactcctacagccacataagttccgatcagattccctgatttcttcgccacattcatgcactgatatacaaggcatgcaaaaacaatgatcaataccacacatccaacaaacccaaattcttctccgatcacagagaaaataaagtctgtctgattttctgataccaaatttacatcacttgcagatacatttgagatcgtattacttccaaatcccttgccaaatagtccgccagcaccaatcgccatgatcgaattgcttgtctgtaaagcagtggaatctgcgtaattctctggatgtaaaaaggacatgatccttgctacctgatgtggctctaacaacacctgtcctggtgtctggacataccacaaaaagattgctaaaagtggtacgcctacgatcaatacctgaacgatcaatctggaggataatcctgccataaagatcattccaagaataataaaacaaatatcgagtgtagaagaaagacttggctgtttcaagatcaaaagcagcgggattccacagattacagcaagttttcctaataccttcggttcattcagatcatcctgatgcttcgcaagaaatgctgcaacaacaatgatcatgatcactttactaagttctgatggctggaaagttcccaatggacctaatgaaaaccatcgtttggcaccattgacatcttttccaaataatttaacgccaatcaacatgatcacattcaaaatatacaatatttctgcatttcttgtaaagacctgataatcgatcagtgatacgaccacaatgattccaagtcccataatgatccccaatgcctgctttggcacataggatgctttggcactgtgaataaacaaaaggctcatcgccatcagtacaagtacgttaaaaacaagtttgaaattgtaattctgcagtcgataatttcgcaacatagtatctctccaatgttattttctaagctcacggatcggaatatttgcatataatgcaggtccttcggattcttcgctactttgtgtgatctgaatatcaagtccctctggatcgatctccatatatttggagattacttgaatgatgtcgtttttgatcagttccattgtctcaggagaacaatttgagcggtcagataccaataatagttttaatcggtcttttgccacttctcctgaactttttttcttaaaaaaattatcaaaaaaacccatcgtttctctcccctctacttcttaaatacgtttgcaagtctctgaaagaaagttggtcctgtgatttccatgaatggaacgtctttgcccatcacacgattacagatattctggtatgcttttcctgctggtgtattgcttccaaccaatggttctccctggtttgtggaaatgacaatattctcatcatctggtacgattccgatcaggtcaaccgcaagaatatcaagaacatcatctttggataacatatctccacgttctaccatatccatacgtatcctgttgatcaccagatcgatcttatgtatatcatttgcctctaatagtccaatgatacggtctgcatcacggattgctgatacctctggtgttgtaacgatcagtgcacggtctgctgctgcgatcgcattcttaaatccttgttcgattcctgctgggcagtcaagaatgatatagtcaaattcactttttagttcttctaccagttttgacatctgttctggtgttacggatgtcttatctcttgtctgtgcagatggcagtaagaaaagatttggatatttcttgtctttgatcattgcctgtttgattctgcagtttccttccacaacgtcaaccagattataaacgattctattctcaagccccatgacaacgtccagattacgaagtccgatatccgtatcgatcaatacgactttctttccttccttcgctaatcctgttcccacattggcagtggttgttgtctttccaacgccaccctttccagatgtgattacgataacttcactcatttttgtttcctccattcactatactatgatttcatttaagagcgctttagatatgggctcgatataaatattttcatcttctacaaatgcaatctgtgcttccatcggctgattgtcattattctttgatcttccgaaaagctttttcttcttctctggttctccatcggcacttcttgcgatgtgttttccgatacggatctgcatcggctgcatgtcaagtgctgcgacaaaagcgtgatcatctccatcacatcctgcactcaaatatcctttggcacatccaagaacaactacattacctttggcacatacggaagctccaggattcacatccccgaccactacaacacttgcatcagattccagactctgtccggagcgaagtgttccacggtagaactgtccatctccctttcttctctcatcaaccatggactgacttcttttttgttctctttcctgaatctttttcaatacatccttaaaagaagtttccatgatcttatcatcttctatcacatatgcaatcgtcaaagttgttttttctgcaatgatctgcagtacattctgaagttctttggcatctagttttctgccttcgatctttagtgcgatctgtgtctgtccattaaagaaatcttttgcctgcacaaatttatcttcgatcgctttgatcagttgatcaaacttcattcctggatctaacaccatggtaagtcccagactgtttcccttgagcaataccggctgattcatacaattcctctcttctttctctaatctcttgcagtaccaacactggtttctgtgactgatttattattcttctctaatgtcttctttgtcttatcatttgcaaaataatactcataaatatcctttgcagtcgctgctgcattagatgaggtatatccaaacggaataacaaccgttgttgtgatctctggcttctcatatggtccataagagataaacaacgcatgattcggacgtttcttattctcctgtgctgtacccgtcttacctgctaattttactttcatgccttggaagatactgcttacggagctgtcctttccgctgactacacctctcataccagtatgcactgcattccagtatgttgtgtcataatgaagttgtcttactttcttaactccatatttcttgactgtctttccattatcgtcagtaatcttgtccatgatacttagatcatatacggttccactgttggataatgttgtcacataattcgcgatctgacttggcgtgaaactattacgtccttgtccaatggcagaacgtacggatgtttcatcagaaacctgtggagataactcatccagttcaattcctgactgcttattaagccctagctgtgttgcgtatttctccaagtacttaagaccttctttactgctgtaggaacctgatttgtctcctaatctatatcctacttcataaaagaaataattacaagatgctccgatcgctgttgacacagttcttgctccatgacggtctggatatttccagcacttcgccggtggtgtgatcttatcgtataaccctgtacagttgatgactgtacttgtcgtgatcgctttctcattaagacctgccaaagcagacactggcttaaatgtagatcccggtgctgtcttatgtttcagtgcctgattatataatggtgtagatgctgagtttgccagctgcctgtagtatccggaatctgttccgtttgataaacggttgctgtcatatccaggataacttaccaatgcttttacctttcctgtcttggaatctgtgatcacaacagatccggaacatggatccataccaatctgtcctggtgtgatctgtaaactctttaactttcttcgaatgaaatcatagctgtttagggaaccagatttcaatgccgtataatcactgtcacctttcttctttaaaactccctgttcataaagaaggagacatacttctcttccgcttaattttcctttcatgatgctttgttcgcagactgtcatatcaaaatcatctgcatcaaccaaagcatcttctacataagcagccagtgctttcatgatctcttcagtgtcattgtatttgctgctgatattcagtgaggaaatatcaatccattccttgttcacggcataccttaagaattcacttaaactgatcttctcattcttccacttctgatatgtcttatccgtcgtatcaatagaacttgagatcaatactttcttgctagacaacaggctgtatacataagatgcataggcttgtttttcttcactctgatctttgtacgctttggtatctttcaaaacaagattctttgatacattgatcgcctgatcttctaaagtctgaatctttcgatacatcttcttctcataggatgtcgccttatctccattgagattctcaaggtcgatcacactattgccaataaatgaataatatactttcttgatcgggatcataatattctcacggtcatttcctgcgctgtcagaactcgttagcttagacagaacaattcccgcgatcttcttctcgagcagattatatacatattcctgtaattcgctgtcaatcgataatgtgatattatttcctgttcccgatttgactgtcttggtcgtatcgatgatctttccaacattgttgacaaccagagtcttgcttccactgtctccgtgaagataattctcaaactgcttctcaacaccggcctttccaaccgtctcatcactggaatagtaatctttatcttcttctttctttcctttgttatatgtttcaagttcatccgtattgaccgttcctgtatatccgatcacatgagacatcgcctcacttttattatatacacgaatagactttgtatcaatatctattcccggaagttctgaacttctttctttgatctcggcaatacttctgttattgatttcatttgcgatcgtcaccttcatatactgagaataacggctcaaaaatgcactgtatctgacagacatgatctttaatgcatctttcttggaataagatttatcaatatcaaacatctttcctgttcctgcggagccaagagttccatttctcaaatattcaaaaacctgttctgcagttgcattcagctgtttatctcttaattctttctcggactttgaaaggtctgtgctgtttccaattccaaaaacatctctcttaaacttctttaattttgacccagtctctgtaaaacgaaactttccgcttcctgtatattcaatcggaatctcattgataaaggagtctccatttcgctccaggatcttgatcactttataaatgactttattcttctcataactttctgatgtaccattctttgctgccaatgtctgaaatgcattgtcattctggaaattcactgtatatacaagtttgttgtatgcaagcagttttccattcacatcataaatattccctctggtaccagatgtcttgactgtcttttgtactttatatgtaaaatcatttttatgtgactgaccttctacgatctgaaggacaaacacacgcccgatcaacacacaataaagcacaacgatcagtatgatcaaggcaagcagtctgtttgccagtaatttttctgctttctcgtaaatttttcgtaacactagaacatactccttttttcaccatctctgatcctgatatcaacctctaacaatatcttatatataagcaatgctacgattcccgtatatactgcttccggaatcataactttaaacagataagaaaaaaactgcaatcttcctctcattgcaaaaaagaaaaagaagatcacaaaactatacgcaagggaattcgctgttagaagtccgatcggcagcaagatatcatcctcataaaaatatgtatggaaccatccattgacatatccaaacattaaatacacaaatgcgttctgtcctaaaacatttcctgagaatatatcgatcagcagcccacagacaaatccgatcacgattcccgctttcctgcctcggataaatgcgatcgtgaccgttaagatcagcagaatattcggcataacccctgcaagttttaaaaaattaaagacggatgtctgtaaaaggaaacagactagtaccgatatcacataaaataaaattcgtttgatcttcatatcctcacctgctattcctttgtttcttcatcaagattctttgttttcttaagatctgtgataaccaaaacttcttttaaatgcttgaagtcaacgactggtgtcactttcgctgtcttggtaagctttgtagaatcaagcttcagatcagatactttcccgatcgtgatcccttcattaaatttggaacttacataagatgttacaagctcatctccattcttgacttttgcatctttgctgatatatacaacttccagatatccatcttccatcgtatccagacttccatttacgatacacgcatcatttgtctttaggaacatagcactgaccatacttgtatcattaatgatcgttcgtactttggctgtatgtgatgatacatcatagacaattcctacgagaccattccctgcaatgacattcatgtctttcttaatgccgtctttgcttcctctattgatcagaaagatgtcaaaccagtttcctgatcctttactgatgactctggctcccactgtatgatattttttgtatttttgttttaatttcaaaagatcctgcagacgttctaattctacctgattctgctgtagcacacgattctgcatcttcagaacatcgatcttctcctgtagacgctcattctctgctctcagtgtcttcttgcttttcgcattctcattccatgaaaacacggcatttcctaccgaattaatgccttcctgcatcggagataaaacagtgaaaaagatattcttgactggagttaagactcctccggcaaaaacactgattcccgccagtaacccacacaccacgataaaaatcgctaacaggtggtttgaattaaattttttcttttgcaatttcatacgtctatcctctttcatcatctatcgttttaaatatgactgcattcctaagatcacatgatcttctggccggtcagcaatatgaaccggtatcttaaattcttctttgatccactctgccgtctttggaaatgctgccccgcctccagatacatagattccctgattcataatatctgatgcaagttctggcgtaatgctttctaacactgcttttacctgcacacaaatgtctctgacctgactgtgggccttttcttcaacgatctgaattggtatcttctcttgttttggaagtccactcacaagatctcttcccttgatcatagctgcttctttatcttctatcttcgcatatgcaagttttaagtgtcttgcacttcgtgttccgatcgctaatttataattcttctttacataatctctgatccactcatcgatctggtctcctccatatggaagaagtctgcttgttacgatcccacctaaagatatcacagaaatctctgttgttgaagctcctatatcaatgatcatatttccacatggcgcattgacatcaattccgcttccaattgccgcaaggattggcttgggaactaaagttacatccttaacccttgaagctgattcccatgcaagatcttcaaatgctcgtttctcaacattcgtaatatccactggaactgcgatcataagaccggtttttctgatccgtttgaaataatggtccaataccgttcctaacagatatctcatattcgtataatctgagatcacgccgtgttccattggtttcactacatgaatactgtatggctgtttctcatacatcgcaaatgcttcgttgccgaatgcttttagttttgcatcttcatcaaatgcgatcatgttctttatctttaaaaattcttctttatctcttgtacagattcttaaatgtctggttccaagttcaattcctagttgtgccgttttcatgttctgctccttacatcatgtgttcttctcgaaaacttaaatatgtctggtctccgatgataatgtgatcacatagcggaatcccaagaaattctcctgcttctttcatccgcttggtcgtcagaatatcctggcggcttggcgttggatctccagatggatgattatggatcataagtacggaaaccgcttcacatcgaagtgcttccagaaataattctcttggtgatgccactgtctgattcactgtaccaacagaaaccgtaagttcctttataactttattctttccattaaaaaaaattaaaatcatctcttcccggcttaaatgccgcatccgttccatataataatctgcaatggatgctggtgaatgaaagcttatcttatcttcgactttcgcacttgctaatcgtttagacaattctgcaatacacaagatctgcatcgcctttactttcccaatcccgggaatcttttgtaattcttctcttgaagtgtggcaaattcccagtattccctcataaaacggatcgatcgacaacactttcgttgcaagatcgatcgccgtctgatcctttgtcccacttcttaagatcactgccagaagttctgcatctgacagcattgctgttccattcttttcacacttttcataaggtctttctgacactggtaattcctttaatgtctgatgtttttcttccatatctgatcctttctgtcgaaaaatctccatggtcaaaacatttctcacattaaatcttaccataacttttcactgatgtatagaaatcaaaccgttgttttccttaaatttttcttattttattttatgaaatctctggaatttctaccaaacctttttctgccattcgctgcagggacatgatgattccatatttggcatgtggatatgtaagacctccctggaaatatactgcataaggctctttcattggtccatcagcacttaattcaatggatgcgcccgatacaaatgttcctgctgccatgatcacctggctatcatatcctggcatatcccatgggattggtgttacatgactgtcgatcggtgatgctttttgaattccctcgcaaaatgcgatcaatttttcaggatcatgaaattccactgcctgaatgatatcatgtcggtcttcttttccatctggaatcactttaaatcctaatttttcatataaattggctgcaaagatcgctcctttgactgctgcattgacaaccgttggtgccataaagaatccctggataaactgacgattaactcctagactggctcctacttcttttccaagccctggtgttgtaagtctgtatgcacactgctcgatcagatcgcttcttccacagatgtatccaccgatcggtgcaagtcctccacccggattcttgatcagggaacctacgatcatatcagctccaacttccgatggttctttttcttcgacaaattcaccataacaattatcaaccattacgatcaggtctttattgatctcttttacaaatgtgatcgcttccccgatcacatcaacagataaggttggtcttgtcgcatagccttttgatctctggatatggatcagttttgttttgtcattgatcgcatttttgatcccctctaagtcaaagcttccatcttctaacagatcaacctgtgcatatgtgatcccgtattctttcagggaccctttggattcacggattccaatgacttcttctaaagtatcatatggttttcctgaaattgcaagaatctcatctcccggacgtaagtttgcagataatgcaagtcctaatgcatgtgttccacatgtgatctgcggtcttacaagtgcatcttctgttccaaaaacatccgcatacaatgcttccacagcttctcttccagaatcattgtatccatatcctgttgtgccacccagatgcatttccgcgatctgatgtttctgcatcgcatttaataccttgatctggtttaactgtgcgatcgcatctaacgtttcaaaacgatcttttaatcccttttctacttcctgtgcatagtcgaagactttctcatcgacgcccatttctttataatagttctttaactgatccatcatagatccccttttcttttaatattgtaagcatatatgttaaaatctcatcttctgacccaaattgtgatttatctaccatacagacttccttttctcttccaaaccaggtcagctgacgctttgcaaagtgtctggtgtctttcttgatctgttcgatcgtatcctccaaagaaagatttccttctaaatactcaaacacctgacgatacccgattccctgcatggaaaccattgttttttcatatccttcttcttttaatcgttttacttcatcgatcaatccttgttccgccataatatcaacgcggcgattgatcctgtcgtataagatatctcttttgtggtttaatacaaaataagcaaaattatatggtgaggtctttgctgcttccttctcattatgctctgagatcggatatccatttaatttataaaattctaatgcacggatcacccgctttacattatttttatgaattttttctgtagattttggatcgacttgttttaacatctcgtataaactgtcgtttccttctcttttagctttttcttccagttgttttctgtattccttgtctccatcttcttttgtgaaatcaatatcatataaaagactttggatatagaatcctgttccaccaacgatcagtggaatcttgccttttgcatagatttcctttagggcatcttttgccatctgctgaaatctcgctacatgaaattcttctttaggatcaagttcatccaccagataatgcttgatcccttccatctcttccggcatgatcttggcagttccgatatccatcttcttataaacctgcatagaatctgcggaaatgatctctgcatctaagatctttgctaatcggatcgacagttctgtttttccaactgctgtcggtcctgttaaaattaccattggtttcatctatttaaaatcctttcggcataagttctgataatcgatatgtttcaaatccatctgggctttgacagattactttcagatctggattgaattcatgtagaaactggcggcagatcccacatggataaaccgtttctttgtcactgccattggatgcgatcgcgatcatttcaaagtcatgatatccttcactgacagctttgactgccgctgttctctctgcacaaatggctgctccataagaagaattctccacattacacccggtgaatacttttccttctttggtaagaattgctgctcctacttgaaatctggaatatggtgcgtatgctttctcttttgctttatctgcaaaatctaataattgctgatctgtcatagtcttccctccttgtctggtttcactatacgatcctcttaaacttcttgtctatctcatacttactcatcttgatgatcgttggtcttccatgtggacattggtatggattttccagcttcatcagttcatctaaaagatgttctacttccattaacgatactctctgatttcccttgatcgacatcttacatgccattgtcgcaatctttgatgcgatcacttctgtatccaaggtaccattttcttgacttaccgcatctaaaagttccataaataagtctctttccccgattccatagagattggctggaacttcccggatacaatattcattccctccaaaagattcgatcgtaaatcctaaacctgcgaatgcatctttgtatcttattaacgcttctgcttccgtcatagaaaccgtcacaaccattggcggttctaatctctggctgtatatttctttttctttgaaattcttcatcagcctctcataattgactttttcatgtgctgcatgctggtccataataaataactggtcttcgtactcaataagccaatatgtcttaaagagctgacctaagatcttgcggtcaggtcttgcctgaactgaaaatactggatcttctcttagtgtcatctgattgctgcttaattcatcggtcttgtattgtggaaattcttttttctgagtattgtagtttaagcctgcataagtcggtttctttgtattttttgatgattcgctggctgttggtgttttctttacaggatgtgacggcttttcaatctgttgttgtacaacttgcctttgcttttcaacctgctgttgtacaccttgcccttgctgctccatctgctgaacctcttctttccttcggttcacctcaaatggctcaggctttttcacttcttttgtcttcggcaattctttcttcttcggtgtctctcttaatacatcctgcaccagatctttctgaagtaatgctgctctaactgcatctactacaagctcatagatttctcttccatttcggaaacggatctccatctttgtcggatgaacattcacatccagcagttcctgatcgatcttgaaatcaaggcacacaaatggatatctgtgtttcatcgtaaaggtacgatatccttcttcaattgccttgtaaatgatcgagcttttgatatatcttccattgataaagtaactctcatagtttctgtttcctctggaaacatacggttttgcaacaaatcccgtgactttcacatcttcattttgtgcttctagcgggatcaatgctcctgccacatctcgcccataaatatgatagatgatgtcctttaccttaccatttccagaagtgtaaatcttatttttattgttatggataaatttaaatgaaatttccggatgacttagggcaatgtgtaccatcatctgttctacataccctgcttcggttgtcgcactctttaagaattttcttcttgctggcgtattataaaacagattctttaccagaaatgttgttccatcgggtgctccgatatcgtcaaaagcttcttcctcgcctccatagatcttataggatactccactgaagctttctgcagtcttcgttaccagctcaacctgtgcaactgcgctgatacttgataatgcctctcctcgaaatccaagcgaagatacacttaacagatcttcaaccgaacggatcttgcttgtcgcatgacgtaaaaatgcagtctttacctgatcttttggaattccgatcccattgtcagttaccctgatcaatgtcattccgccatctttgatctccacagtcactgcatttgcttttgcatccactgcattttccacaagctctttgacaacagaagctggccgttcaataacttctcctgctgcaatattatcgatcgtcttttgatctagtaattgtatcttcgccataaaattactcctcgttctttaacttctcctgtaacacatataaataattcaatgcttcaagcggtgtcatgtcagaaagatctttttctcttagttctgccataaatggatgttccatcgttggttcatcgctttctctgaagaaacttaactgttgtgcctctccatatggcatgatatccttcgctcctgacgtcagatcatgttcttctaattctcttgcgatctcttttgctcgattgatcacggcatctgggactccggcaagttttgcaacctgtactccataactcttatctgcaccaccttttacgatcttgcgcaggaacacaatgtcatctccctgttctttgacagcaatgcagtagttatgtacactgtcgatcttaccttctaactctgtcagttcatgataatgtgtcgcaaacagagtttttgcaccgaggagcttggaattgctgatatattccacaactgcccatgcaatagacaacccatcaaatgtactcgttccacgtccgatctcgtctaagatcaacaaactgtttttcgttgcatttcttaaaatattggcaacttcactcatctcaaccataaatgtactctgtccagaagcaagatcatctgatgctccaacccttgtaaagatacgatctacgataccgatatttgctttcgccgctggtacaaaagaaccaatctgcgccattaatacgatcagagcaacctgtctcatataagttgatttacctgccatgtttggtcccgtgatgatcgctacacgattcttcttgttatcaagatatgtatcattagaaataaacatatcatttggaatcacctgctccacaaccggatgtcttccatccttgatatcaatcgtccctctgacatttaacttcggacgtacaaaatgattgcgttctgcgacatatgcaagggaggcaagtgcatcgatctgtgcgatcacattcgctgttcttgagattcgttccatctctcctgctaatgtttcacggatcataacataagtttcatattctaacgcatacagacggtcttcggaacccaggatcgtatccgccagctggtttaattcttcggttgtgtaacgttcggaattggccagtgtctgcttacggatataatgatcaggtacaagatctttgtaggaatttgtcacatctaaatagtacccaaatactttattgaacttgatctttaagttcttgatccctgttttttcacgttcccgttcctcaagttccatcaaccattgctttccttctgttttagcacgttttaatttgtctatatcttccttgaatccttccttgatgatcccaccttctttgatcgcaagcggtggttcttcaatgatggaatcttccaaaagattgtggatatcttccaatggatctaaatcttctcttaatccagacaataatggatctttgcattcttcaagaactgttttgatcgcaggcagcaattccaacgatgttttaaatgcgatcatatctcttggattcgctgtcttataacttacttttgtcattaaacgttccagatcatagatcggatttaagtattctcttaattcttctcttacgattgtctgatccgtaagtgttgtgatcgcatcgtatctctcttcgatctttttcttgtccaccaatggctgctcaaccatgtttcttagcattctggcacccatggctgtttttgtcttatctaatacccataagagtgaaccttttttttgtttatcacgtaatgtctcacaaagttccaaatttctacggctggagctgtcgatgatcataaattcacttgtctcataagcttcaatatgcatcagatgatccagagaactcttctgtgtctcatgaagatatccaagcaatgcaccagttgcgatcactcccattggatgatccacaagtccaaggccttctaaattccctactttgaactgacgcttgatcctttcctctgcctgttcttcatcaaaatggtatggctcaatgcttgagatcacgatcgacatcttgtcttttaagtaatcaaaatccatgccactgatcaaaaatgcatcattacaaatgatctctgccggctcgaacttgaagatctcatctctgactttcgctaaactgtccattgacgttgttctaaaatcgcccgttgtaacatcaacaaatgaaattccgtaacttccatcatttgcaaaaatacacatcagatagttattcttctcatcatcaagactctgctgggaaatattcgttcctggcgttacaatacgcacgatctctcgttttacgattccctttgcctgacttggatcttcgacctgctcacagatcccgactttatatcctttttctactaatttatttaaataggaatccacagcatgataaggaacgccacacattggtgcgcgctcctcaagtccacagttcttccctgttaatgtgatttctaattctttggatgctgtcagtgcatcatcaaagaacatctcatagaaatctccgagacgataaaataagatacaatctttattctcttctttgatctgcatatactgctgcatcattggtgtcagttttccttttttagccatggatctgctctcccatataatagaaacctttttcctcaactaatttaacatctgccattgtaccaatctgttctttgcatcctttaaaatgaactaacaggttattttccaatcttcctgttaacattccttcttcgtgcgtattctcttcttcgatcagaactctctcgatatctccgactttcttcttgcaattctttgcagatgtctcttttaataaggcaagaagtctgtcaaaacgatctttgatcacatctttgtccacctgatcttccatgctcgctgctggtgttccggaacgtttcgaatatacatatgtgtatgcactgtcaaatccaacttctcttacaacatctaatgtctccttgaaatcttcttctgtctctccagggaatcctacgataatatctgttgtaaaagacactccagggattctctcctgaatcttcttagcaagtgctacatactgttcttttgtataatgacggttcatcaattttaacaaacggctgcttcctgactgcattggaagatgcatatgtttacatactttcttgcttgttgccatcacttcgatcagatcatccgataaatcctttggatgtggtgtcataaaacggattctttctagtccttcgactttctctacttctcttaataattcagcaaatgacattggttcttctaatgtctttccataagaatttacattctgtccaagaagcatcacttctttgacaccttctgatacgacctgctttacttctttgatgatatcttctggcttacggcttctttctcttcctcttacatatggcacgatacagtaactgcagaagttattgcatccatacataatattaactccacatttgaatgagaatttacggtcacttggaagatcttccacgatctggtctgtatctttccagatatcaacgatcattcccttggagtctactcttgcttttaataattctgctaatttaaagatattgtgtgttccaaagatgatatctacaaatttatagcttgaacgaatcttctcgatcacatgctcttcctgcatcatacatccacataacccgatcatcatctgtggatttctctctttcatcttcttaacctgccccaaatgtccatataactttgtattggcattctcacgaactgtacatgtattaaagatcaggaagtctgcttcttctgtttcaacttcttcatatccgatcgtttctaagatccctaataacttttcagaatccttctcattcatctgacagccaaatgtggttacatggcatgtgagctttcttcccaattcttcagactttttctgaaaccattttttcatttcttccatatattcatactgtcttgacgactcgttctttaactgttccattctattatttctcctacttttataattcatctctatttttacagtatcgttaattataacaaatttgaatgagtcatgcaatgtatatgagaaaaacgaaacaacagaataagggagccagaccagattgtttagaccttttaaaatctatcggttgtttaaatctttaataaaaatccaataccatacaacatacacatttgtggtggtttgaatagcgtagattatttgaatattataaaaagacggataggtatctgaaaccgtaggagcacgcatgcacttagtgagtggtaggtcgtaagacctgccaggagcttagtacatctgcgtgcgagtcgagcgagagtgcgtttcagatacctatccgtctttttataatattccaccaataatttacactatcaaactaaaatttttcttgtcacattgcttcgtttaaagtaaaatataagtaatatttatgttaagttattgttaagaaggagaactgtcgtatgaactatactatcatacttgctctgatgggaggccttggcctctttctttatgggatgaaactgatgagcgatggacttgagaaagctgccggtgcgaagcttcgccggattcttgaaatatttactacaaaccgtttaacgggtatgttagtcggaatcttttttaccgctgttattcagtcctctagtgctgctactgttatggtagtcagctttgtaaatgcagggcttatgaacctgtctcaggctgctggagttatccttggtgctaacattggtactactgttacttcccagcttgtttcttttaacctttctgagattgcccctgtctttttaatggcgggtgttattatggtattatttataaataatcctaccgttcagaaagtgggagaagttattcttggatttggtgttttatttatgggattaacttccacgtcaagtgctatgtctgtgttaagggattcacctttgatcacatcttaccttcagaccctggataaccatttccttggtgttttatttggatttatcatgactgcgatcttacagagttcttctgttactgtaagtatcgttcttttgatggcatctcagggattattacatcttccaatctgcttctttattattcttggatgtaatatgggatcttgtgtgtccgcattgcttgccagcttaagtggtaacaagggtgcaaaacgtgctgcgatgatccatttcttatttaatgtatttggaagtatcatcatctttacaggacttagctttgcacttactcctatcacaaactttttcttaagtatttccggtggaaatcttggacgaagcgttgcaaatgctcatacaacatttaagatcattgaagtgttatttatgttcccatgtacacctttagttgttgcattaacagagaagatcatccgtggaaaagatgaaaaagtccaccataatgaactgcagtatattacagagatttccttaaaatctcctgcaacaatgatccctcaggcgaagaatgagttaagacgtatggctaatatggcacaggagaatttagaccatgccatccacggatttctaaatcaatccgatgaatttgttgataaaatctatcatcgcgaggaagatatcaataatgtcagtcatgcgatcactgattatctggtaaagtccaaccagctatcactgcctttagccgatcagaagatcttgggttccatgttttatgttgttaatgatatcgaacgaatcggtgatcatgcagaaaattttgctgattttacaaaaacagagatcaaacataacactggacttactggagatgcaaaagaagaaatcaaaaagatgtacactgctgtttccaaactgttaaaactttccctggaatgtttcatggaacaagatggtgtcaacaaacctgaagaaaagcttgctgagattgcaattctggaagcttcgattgacaaaatggaacgcagatatcaaaaacaccatatcaaacgtcttgccaaaggcgaatgtgaaccaagagctggtttattgttctccgatatgctttctgaattagagcgtattgctgatcatagtgtgaatattgcttattccatgagtgatgaagatgaagatgaaatacttgctgctgagaatgacgccctcactgctaagaattaaatttgagttgaacatagaatataataaaaggatctgcaaacccttttgatactttatgtatctttgatctgcagatcctttttctttttttcttttataactctatcactttataatctataggtgctatatttgtcttgatcacagcgttgctcaagttctttaacagcgcctgtaatgcattctcatttcccccttctttgaccttgttgagatctagattgatctcttcttttttcatcgtcggattgacgagaagtaatattgctttgttctcacttgcttctccaaaaacatcttttttctcgctgataaatcttaaaatcgcaaggacattttcagtcggtgccatgtataatgcatatcctgtctgtaagactttttcacggtttctaaggctagtcagtctcaaaacttcctgataggtttctttgtcattttcaaaaaatgctcctcggttaaatgggtccatcagtccatgcattccatattcgtctccataataaatgcatggcattcctgggacaaagaactgaactgccattgcaagtcttgtgagtgcttttcctttctgatccatctttgatgttataacatattctgcctgctgctctctcgatggcagattctcattcattccggttgcaagtgttgtccgaattcttggaatatcatgagaagataacaggttcatcagtgcataatacaatggttttggataattacactgttgggatatcaagaatgtcttcatatctttggcactttgattgccgagtaaataatctgtaacgttgactttcagcggatagttcattgcgctgtctaagcctttacccaaagcatatttacgtttcgttccgtaactttctttggttgtgacatcttcccatacctcaccgatcagtgtataattcttgaatttcttctttaattcacttcgcaatttaaagataaattcatctggaagttcgtctgcaacatccagacggaatcctgatgctccaagttttaaccaatgcttgatcaccgaatcttctcctgtgataatgtaatcaacaaacttttcatttaattcattgacttccggcagtgtttcaaacccccaccagctcttataagttccatcttcgttaaagtcataccaatcatagtactttgactcttccccttgatatgcccctggttcttcgtaatttccctttttgttaaaatagacactatcatccccagtgtgggaatataccccatccaagatcacatgaatcctgcgttctttggcaagctggcatagccgcttaaaatcttcgttatttccaaggaatggatcgactttcttataatctgatgtattatagcggtggtttgatgctgcttctccaatcggattcagataaatacaactgatccccaatcgtttcagatcatcaagtttggatatgattccctcaatatctccaccaaaataatcacatggatcataaaattcttttcccggaagtggtccaaatactggttgttcttcccagtcatcatgcagatagaccgttcttcccatactttcatgatatactttcccgcgtttcatattttctttgtttccctggcagaaacgatctgggaaaatctgatacatgattccttttgacatccaccttggggtgtcaaaatcttcttcatacacagtgatctgaaaactatccgggttgtcatcaacgatcattccttctccttgtgtcttcccatgtctggctccataaaaataacatttcccatgttcccagattctgaaataataccagacaacacctgcttcactggtcatctttatgtgttcttccatgcagtctttttttcgtttcatctcatactcccggtgaaaactttcagaatacatgatgatctctgccttattgacttcctgccctacatcatacaggcggatcatcatctcgcttccacatgtgactgcacctacgggagttctgtatttttctactgacgcgttatgaatcataatttaatctcatcttttttgtaactcttattttactggtttcagattccagattttttcattatattgttcaatcgttcggtctgatgaaaaatatccggattttgctgtattaacaactgcttttttgatccattcatccttatgatcgacatacaaatgatatactttttcatatgtttcaatataagacggaaaatctgcaagtatgtagtatggatctgcctctccatattccccaaataaaagattctggtaaatctctgaatattttctgtttccgtatcgtaacagatttccttcgatcagacaattacatacatcacggattcctggatgattctcgaaaataatccctggattgtatgtatggtacattttttattgtaattaccctcagcgctgtccccgaagataaagatattctcctgacctacacgctctgcgatctctatattggctccatccatagtgccgatcgtcaatgcaccattcatcataaatttcatatttcctgttccagatgcttccattcctgcggtagaaatctgctcactgatatctgctgccggaatcagcatctccgcaaccgatacacaataattttctacgaaaaccacctgaatctttccgtccatatctggatctttattcaccatttcctgaatggaatggatcagccttatgatctcttttgccctggcatatcccggtgctgctttcgccgcaaaaataaatgtgatcggtgttgtaatacatgttggatcttttttgatcttctgatatatataaatgatatgcagacattttaacagctgtcgtttatactcatgcaaacgtttgcaatgaacatcaaaaatagattctgggttcacttcgatcccttgcttttctttgatatactttgcaaaacggatcttattatttcgtttgaccttctcatattttttacagaattctttgtcatctttatatggaaggatctgttcaaacaggtggtaatcttttaaaatatcccctttcacatactctcttaccagatgatatagcccctgattggccagtgctaaccagcgtctgtgtgtgatcccatttgtgatcgcaagatatttttgtggaaagatctgataagatcctttaaaaatcctcgtttttaaaatatcagcgtgaagatttgaaacaccattgatcctgcggcaaagagctacgcataggtttgccattcggatctcattgtttccgatcactgccatctgtgcgatcttttcttcttccttgctgtaatatacggaaagtttctgacagtatttctcattgatcgcgcaaatgatctgatagattcttggaagcagtaaacgaaacatattctcatcccaacattccattgcttctgtcatgatcgtatgattcgtataatgaaatatcttcttgaccataccatatgcctcatcccatccaaaatcttcttcatccatcaagatcctcataagttctggcatcgccaatgccggatgtgtctcattgatctgaatgacaacatgttctggcaaggagttcagatcatcaaatactgctttatgtctcttgatcatcgactgcatcgttgcagatgccagaaaataaaactgttttaaacgcagcattttaccctgcatatgatcatctgacggatataagactttcgagattgcttctgcaaatgtctggtctgccatcgctttatcatagattccttcattaaacgaatgaaaatcgaaccgccgcttgcttctggcactccacagacgaagagttgctggcgtcttagtcttgtatccaatgatcggtacatcatatgggactgcaatgacggtattataatctttatgttcaatctttaatccattctctgtccagttttcctgaatcgttccattaaaatgtacttccacacttaattccgggcgctcgatctcccaaacatttccatctcttaaccagtcatcttccatctcaatctgcgttccatctacaattttctgacgaaacattccatattcatatcggatcccacatccgagtactggaagttccatcgtagaaagtgaatccaaaaaacatgctgccagtcgtcctagtcctccatttccaagtcctgcatcattttcttcatccgtaatcttatcaaaatcaagtcccatctcccagaatgcttcccgatatgcctcatataatccttgactgatcagattattagaaaatgcccttcccatcaaaaattcggctgacatatagtaaagtttcttaactccctgctcttgtaccctttttctgctgtctgcccaggatatcatgatatcatccctgatacactccgctgctgccttatagatctcatcatttgttgcctcactgatcgttcttccaagtgcatgaattaatttattctcaatccgttgtccgatcttattgctgtccatatagtccattgtgatctaagcctcctttctagtctttatctttgacctgtaaatttatctcattttttgtctttatgaagaatgggcatcttaaaataagatgcccattcttcttttgaatttataatacactattatacatatcaagataaatctttgcagattttgcaaaactgttatcggattccatcgctctttggatcaatccatgttttctctttggactctgcaatgtctgtaatgcataacggattgctcccagcatctcatgtgcattgtagtttgcaaatgagaatccatttcctgtgtcctcgtattcattgtaactttgtactgtatcacgaagtccacctgtctcacgtacgattggaagtgttccataacgaagtgcgatcatctgagagattccacatggttcaaatttggatggcattaagaagagatcacttcctgcataaatctggtgtgcaactgcattatcatatgcgatatatgagcatactcttcctttgtatttttcttccatgtaacggaaaaattcctcatattcataatcacccgttccaagaatgacaaatgcgacattctctgtacacatgatctcatccaacatgtatttcacaagatccagacctttctgctctgttaatcttgtaaccataccgatgatcggaactcctggtgtgatcgataatccaagagccttgatcagttcctgtttatctttcttctttccagaaagatcatctttgttaaaatgatatgggattagtggatctgtctctggattaaattcttcttgattcattccatttaagattccccatgtatctcctgctctcgcatttaagataccttcctgacggtatgcaaatgctggatcacgaatctcctgtgcataagttggacttactgtgcttaaacgatctgcaaacacaagtgctgctttcatgaaacttgcacattcatagttatgcataaattctggtgtgtcatactttggatcgattcctaaccaatgttcaaactgatcgaaaccaaattctccttgatacatcatattatggatcgtaaagatcgtctttgcatgtccaatatcccaatgtccgtactgtgtgcggagtaagataggaatcagacctgtctgccagtcattgcaatggatgacgtctggaataaatccaatacggcttgctgcttcgatcacggcacgacagaagaaagcatactgctctccttctgcaagtccaccacgatataccgcatcaccaaaaaatccttcattatcgatcagataatatgtaacttcattataaaccagttcttctacacctacatatgtttccccaccactaaaattgatgttgaaatctgccagatgtcttgtctgtgcgccatatttccctttcatctgactatgaaacggcatgatcacacgggcatccgcaccgatctgattcaattcctttggaagggttcccataacatccgctaaccctccaagcttcacaaatggtgcacactctgcccctgcaagcagcactttcagtgaattgttattactcattaacacttgctcctttcggaataaatactggatggtttgatgatcctgataagtgtgcatttgaataaacttttacgtgtcggtctaaaattgtatggttgatctctgcctgtggtgcgataaatccttctgccataacaacagaattcttgatcacagctccctctgcaatctgtgatccacggaagatgacagagttttcaacttcaccatcaatctcacatccactactgatcaggctgttgctgactttcgcatttggtccatattttgctggtgctccatcagcagattttgtgtaaattcttctattacccaagaataattctttgtaaacatctggttttaacatatccatatttacattataatatgcttctaaagatgtaatacatcctacatatcctttatattcatatccctgaattacaagacgatcgaagtttggaacgataacatcaaagaaaaagtgtttcttattatgtgcgatcgctgtctcaataaaatcgatcaataatgttgtcttcatgatataagcatccatgctcttcttatttgaacgatgttttccttcagaatagcacatatcaagaactttatcgtcttcatctgtttttaaataaacaccatcataatcgcagtttgttgaatcatcactgttatcaaaatacatcagtgtgatatctgctcctgatttgatatgtttatctaacatatcctgaaaatctgcattacagatcacataagaacgtcctaataatacatatttttcttttgctttctttaaaaatccaagtgttccacgaagtccatccataacacttgcgtattctccggatggagatgcatcattaatatatggtgggaagatatataatcctccacgttttttgtttaatccccagtcttttcctgaattcacatggctcaacagtgaatcgtaatttcttcttgttaataatcctacattcttaatccctgcatttaccatgttacttaacataaagtcaactgtacgataacgtccaccaaccggaagtgctgataaacttctggagcgtacaaggtcttttaattttctattttcttctcctgcattgataatacctaacatctgtttatccatatcttcaatcctcctagtgtaagatggtatctgggtagatcattgctccgtcttcaacagtcgcattctctaatgcaacacaatgatatccgattacagttacattatttccttctccaaccttgcatccctgctcgatgactacttcttcatcgatcagtgctttgtcgatctgacagtctgttcttacaacagtatctttcatgatcacactgttcttaactacactgccttttccgatcttaacaccagaatggatgacacagttctctacttcaccttcaataacacatccatcggcaagaatagaattcttaacagatgcacctggtgctatataatgaggaggtaatgagaagtttcttgtgtagattctcatcttatcatcatttaagtcaatctgaggattttcatccagaagttccatattagcttcccataaactgtcgatcgttcctacatctctccagtatccatcaaatgagtaagcatacatctttcttccatcttctaacattcttggaataatgttcttaccaaaatcgtgttctgactctggatcatttccatcatcgatcagatactgacggatcagtttccatttaaagatatagatacccatagaagcttttgtactctttggttctgctggtttttcttcgaattcataaatacgttcatcttcatctgtattcatgattccaaaacgttttgcttcttcataagttacattcagaactgagatcgtacaatctgcacctttctctttatgatactgaagcatcttgtcataatccatggtacagatctggtcaccagataatacaatgatatgatctggatcaaaattatcaatgaaattgatgttctgataaatcgcatctgccgttccacggtaccagttacctgtttctcccttcatatatggaggtaaaacataagcacctccgtttaagctgtcaagatcccagaatcctccagtaccaatatatgcatttaactccagtggttcatactgtgttaaaactccgactgtgtcaattcctgagtttgtacagtttgacagtgggaagtcaatgatcttatattttccaccataggatacggctggttttgctttcttctgagttaatgcgaacaatctgcttccttgtccccctgcaagcagcatcgcaacgatttcttttttgttaatcatagctctttgtcctcctttattttacaccttgatcattattcttttttgttcttcttgtcttgcttgttcttttttttggctgttcctcttctttctctgttgtttgctttgttacctttatatcttcttttttgggagtgtctttcttcgttgccggcgcctcttcttttgttactttctttgtaacttccggctttttctctactgttttcttcacagcttctgttttcttctcctgtgccgccttctttgctggctctgctttctttgcagtggctttctttgccggctctgctttctttgctacactcttccgtggtttcgtctccacttcctcgatcttatagtaaacaacacttaatggttttaaggaaatttctgctgcctgttggtaaacagctttctttccttcagatggtactttcaccctcttcgttgaaactttagattcggaaacatctccatctccaccaaaatcaagctcactgctgtctaagatcttcgtaagttttgatttctttggtaatggaaccttgtatttatcccattccatcggtgtaaaattgcagacacaaagaatctgttgttgttttcttcctctgcccttcttattctttcgtataaatgctacaacactgtggtctgcatcacgttgcaagcaccattcaaatcctgctggatcctgatctaattcatataatgccggttcagatttgtaaatctcatttagtttagctacatatttgtggaaagaatcatgcatctcatactgatcgatcaagaaccagtcaagctgttctttgtctctccattctacaaattgggcgaattctccacccataaataataatttctttcctggatgtgccatggtaaatccatataatgttcgcagtgaagcaaacttctcatcatatgcaccatacatcttattgatcatagaacctttgccatgaacaacctcatcatgtgaatatggaagaatgtaattctcactgtaagcatagtccatagagaaaatgatcgctccatgattatccttacgatacaatggatcaagttccatatagtaaagagtatcatgcatatatcccatattccacttgtaaacaaatcctagtccttccggatcatcaacatcacttgttacctttggatatgctgttgattcttctgcgatcgtcaagaatccctcatgtgttgtacgaagtgcttcgtttagattgcgaaggaaatcaactgcttcatagttgatattggttccatcttcattcggcacatattctccttcctgtttcccaaagtcaagatatagcattgcagatacagcatcaatacgaattccatcgatatgataaacatctgcaaagaacatcgcacttgagatcaagaagctctgtacttctggtttcccatagttaaataataaagttccccagtcaggctggcttcccttccttggatcttcgtgatcataaatatgtgttccatcaaacattgccagtccatgctcgtctcttggaaaatgtgctggaacccaatcaaggatgacactgatccctgctttatgtaactcattgatcatataattgaaatcttctggtgttccatatcttgatgttacgccgtaatatcctgttacctgatatccccaagaaagatcatatggatattctgtgatcggcatcagttcaacatgtgtatatcccatctctccaagataagggatcagcatgtccgcgatctcacgataattataaaattctctctcttcttcctgcggcattctccatgttccaagatgcagctcatagatagacattggctgatctaatgcctggcgtttctttctctgattgataaaacgtttatcagaccatttaaaatcatcgaaatcccagactttcgaagctgtatctggtctgcattctgcataaaatgcaaaaggatcactcttatatctgcagattccatcatagccttctacatgatatttatacagatcacctttcttcagtccttcaatctcgatcgtatagatcccgtctttgtcacctttcatcggatgcgcaagaggattccagaaattgaaatcacctacgacactgactgactttgcatttggagcccaaacagtaaatctgtgagtctttgtcttcttctgataatggcatccaaatgtcaggtatgcctgccttgcctttcccgtctgaaacaaatacaaatcctcacgattgatagtttcattcatagtataactcctccttaaaacttcaaaacaaagaattcttgtgatcgaatcccacacttacagaaaatcttatcttataagacttctttgtgaaactaaaaagtctaataaaataaaaaagcgtaaacaaccacgaacaatcttcttgcaaatggcttatttacgctttcatagtcatatctttaatttctataggtataataaaaatgtgacacgttgtcatcttacaagatattttcatattcaaagaacaatgtactgtaaatatctttcgtttctagtccactttctggttgtttatctgctgttcaaaaagtgtttgtttcactaactttattataccaaatcttttcatatatttcaacaaattgtacaatatttaatgcactatttatatccatattgtgaaattcatccaagcaatttaatatacagatgtagaatttctcattttaggatcatatcctgcttttttcaaggatttaatgatcttatttttatgttctgtaccgaatgcttccattgtgatcgtaagttctaccgcactatttctgttgatacttacgaactggttatgctctagtttgataatatttccctgtgcatctgcgatcacatcagaaactttatttaactctcctggtttgtctggaaggaatacagataccgtaaagattcgatctctcatgatcaatccatgctgtactaaagatgcgatcgtaatgacatccatatttccaccactgatgatagaaactactttcttattcttaacatccagatgttttaatgctgcaattgttagtaatccagagttttctgctaacatcttgtgattttctaacaagtctaagaaacatgggatcagttcttcatcttctactgtgatgatatcatcaaggttttcctgaatatatggaaaaatgatctttcctggtgtctgtactgctgtaccatctgcgatcgtgctgacatgatcacatgacactacttttcctgcttctaatgaagctttcatacatgctgctcctgctggttctacaccgatcactttaatctttggatttaacagtttggcaagtgttgaaacacctgttgcaagtccgcctccaccgattggtacaaggatgtaatctacggttggcagttctttaaagatatccattgcgatcgttccctgccctgttgcaaccgttgggtcatcaaatggatgaacaaatgtatatccatgttctgctgcaaggtctaatgcgtgtgcacatgcttcatcataaacatctccatgaaggatcacttctgctccaagatcttttgttctgttaacctttaacagtggagtggttgttggcataacgatcgttgctttgactccctgtcttgctgctgccaatgcaacaccctgtgcatggtttccagcagatgctgtgatcaatccttttgctttttcttcttcagataatgtactgatcttgtaatatgcaccacggatcttgtaagctccagtcaactgcatgttctcaggttttagataaacatcgtttcctgtctgatctgaaaaataatcacttttgatcagcttggtaggaaggacaacctcctgcactttattatatgcagcttcaaaatcttttagttctaacattttaattttcttctcctttttcgaataatgcattgacaaacatatctggatcaaatctctgaagatcatcaacctgttccccaataccaatgtattttactggaattccaagttctgactggattgcgatcgcgattccgccttttgctgttccatctaatttcgtcaaaataattcctgaaatgtctgttgcttctttaaactgttttgcctgtgccatggcattttgtccagttgttccatctaagacgatcagtgtctctaaataagcttcactgtattctttttggatgatacgattaatcttgcttaactcattcatcagattcttcttattatgaagtcgtcctgctgtatcacataacaacacatcgacatctcttgcttttgctgctgctaccgcatcatatacaacagccgcaggatctgcaccctctgcttgactaatgatatcaaccccagcacgatttgaccattctttgagctgttcgatcgctccagcacggaatgtatccgcagctgccagtaatactttttttccttgtccttttagtgatgctgcaagttttccaacagatgttgttttccctacaccatttactccaatgacaagaacgacactctttttatcaataaaatcataagcactatcttccagtctcatctgatccttaatagaatcaatcaaaagctgtcggcattcttccggctctttgatcttattttcttttacttttttcttcagatcttcaatgatattcattgttgtatcaattcccatatcactcatgatcaaaatctcttccagctcttcataaaaatcctcatctattccagaaaatccgctgaaaatagagtcaaaacttgaggcaatattatctcttgttttacttaatccctgtgcaagtcttttaaaaaatccttttttctctgacatagccattctccttttattcatctaaatcattctcgatcaaatttacagaaacctgagttgaaatacctttttcctgcatcgtgatcccatataaaacatctgctgccatcatcgttcctcttcgatgtgtgatcacgataaactgtgtatcctttgtaagtttatgcagatactttgcaaatcttgtgacatttgaatcatccaatgccgcttcaatctcatccaggagacaaaacggagatggttttaaattctggatcgcaaataataatgaaatcgctgttaaagctttctctccacctgataactgcatcatattctgaagtttctttcctggaggctgtgcaatgatcctgattccagattctaatacatcatcatctgtaagttccaatcttgcttctccaccaccaaataattccacgaatacttcctgaaatactcgtttgatgtctttaaactttgcattaaactgacggcgcatcgcatcttccagttcttccatcaaacctgtcagatgtgcttctgctgtcacgatatcttcatgctgtttctgcataaattcgtaacgttcggaaacttctttataatcttcgactgcattgatattaactggtccaaggttcttgatcttattttttaactcagagattgtttccttaacctttgtaaggctctgcgtctcatccagatcgatcctctgttttgcctgatgatatgtgatctcgtaattctcccacatataatccaaaagttcttttttctttccttttcgattctctctctgactctccagacggtacatttctttgtcatatccactgatacgttcaagcatctcttcgcgttctttaaggatatccttataaaggacttctttctccttcacttcttcctgcatcttctgatgcctgttctgatcttctatgatctttcgttcaattacttcgcatgattcttttaaatgttcgatctgctgttttaatgcttttacattctcattgatacttccagtatctttctgattttcttgaacctcttctgatagatgttcgatctcagatcttactcgctcctgattattctcctgaaattctaacttctgtgattctttgcttaactgcatatgaaccttggaaacttccattgcatgctgttcggcatgttttctaagatgttcaagtatctcactgatctccttgatcctttcttcatcctgctcatttgcactttcaagatctacctgttcatcttgcagtctgtcagcatcatcttccgcattccttaattcttcttccagttgttgtctctgtatacttaactgttcgtgcctattatcaagctcttcttttcttcgcttgatcgcagattgtgacatctgctgtgtatttaattccaaagagatttcttgcatctctttctctaagtctatcatattttgctgatattctttgagttttttttcattttcatgatatttttcttcatcttctgtgattgctttcgtccatcgatccagcttcttctttaattcttcaacttctctggatcttccaagcagattactcttattcttaaaagcacctccagacattgcaccgcctcggtttaaggaatccccatcaagcgttacgatccttacactgtgatgatatttatttgcaattttaattcctgcatccatatcttttacaacaagaatctgtccaagcagtgatgcaaataaatccttatatacttcatcatagatcacaagttggttggctgccccgatcacccctggttctaaaagaatttctttccttgcaaattcttttcccttcactgcatccagcggcaaaaacgtaactcttccataacgattcttcttcagatattcgatcatcttcttcgctgttttctgcgtatccgttacaatgttctgaatacttccgcccagagctgtctcgatcgctgtttcgtatttttcttccactttgatgatatctgcaaccgctccaatgatcccagatgtcacagcctgttgttccatcaccttcttgatcccgaatccatatccatcataacgttctgccatatttcgcattgtttcataattggaacgaactctatgatatttctcccttttctggtccatctgcgcctgaatctggcgacgttccgctatcaatgtttcttcgattctcttggcattatgacattcgatctcagatcgttttttcttctcattgatctcttcgatcttctgactagaagaatctttttctttttcctgatcattgatctgccgttttatttcttctatctgatgatccagtcctatgatccggacatttagctgttctttcacagtctgggaacgctcaatcgctccagccacccgcatacggccttctctgacagcattcactcggatttcaatctcttcttgttctctctccagatcctgaatctgcttctgatacaatgcaacttcgctttctttttgtatcttttgttccatgacagattcatattccttacgaatttcttctgtctctgcctcaaatctctttaactgtgctttcttttcattcagatctttatacagcttatccttagactccagatacatactctcacgcatatgttctgtattgatctgttcatttaaaacctgaatctttccttcttttttctgctttgtaagcttcatttcagaaatatgagcagtgatcgtttcgatttcctgttttaaatgatccaaaaactcttcttgttttccgtatttctcttttgctttggcaagtgtctgatttgcctcattgatctcccgctgagcgatttctatcttttcatccagctcttttaattccttctcaagattctgattctcaagcaggaacaacttcacatcttcatctttcaactgatctcttaacaacagatattctctcgcacgttctgactgtttcttaagcggtccaacctgacgttccaattccgttaagatatctgtgactcgtaccagattctcacgttcgatttccaaagatttttgtgtttccagcttgtttttcttgtatttaacaattcctgctgcttcatcaaataattctcttctctcttccggttttccacttaagatctgttcgatctgtccctgtccgatgatcgaatatccctcttttccgattcctgtatcaaaaaaaagttctacgatatcctttcttcggcaggcacttccgttgatcaaatattcactttccccagaacgatagactcttctggcaactgttacttcttcaaactggattggcagactatggtcactgttatctaatgtgatcgcaacataagcagatcccatcggctttcgaagctctgtccccgaaaaaataacatcttccattctagaaccacgaagctgttttgctctttgttctccaagcacccatcgaacagcatctgcaacgttactctttccacttccatttggacctacgattcctgtgatcccatgttcaaatttaaagatcattttatgggcaaaagatttaaagccattgacctcaatactttttaaatacatgtccacctctgtttcgtgttattttttgtggcgtttgatcgcctcaaatgcagcatgctgttctgctgactttttactatgtcctgatcctgttccgatcacattctctccaagacgtgcttctaccgtaaagattttggcgtgatctggaccttcttctccaacaagcacatattttaatcgtccttttccttctccctgaacaatctcctgaagattcgtctttgcatcgaaaaacagaactttattttctacatctttaaataaatatgtctcaatgaattttgttgctgtttcgattccctgatctaaataaatcgcaccgatcacagcttcaaatgcatcagaaagaatggaatctcttgatcttccacctgtcatatcttctcctttgcttaagagaacatatttcccaaggttgatatctcttgcacatcctgcaagtgtcggctcacatacaagactcgccctgatcttgcttaactttccctctgattctttctggtatgtgcgatacagataattacttgttaccagctcaagaactgcatctcccaaaaattcgagacgttcattattcttatctttgctcattcttcgttcatttgcataggaactatgaatgaaggcattccaaagtcgggatggctcatgaaatttaattcctatctgctcttgaaattcttccacactttttgcatccattttcttcttatcctttcacaatctggtctttgatcttctgcgtaatatcttcttcggcaaatgcgatacactgaatgatcgcatttttcatttcttttgcacttgaagatccatgtgcttttacaaccaatccatttaatccaagtaatggcgctccaccatattcagaagcatcaaatttctttaacgtcttctttaatgctggtttcgctaatagtgcaccgatcttactctttaatgttgacatcattccttctttgatctgactgactaacactgctgctaatccttcttccagtttcagaacgatatttcctgcaaatgcatcacatacaacaacatccgctgcaccgtatgggatttctcttgcttcgatacttccgatataattgatattttcacattcctttaataatggacctgtttcttttaccagctgatttcctttggcttcttccacaccgacattgacaagtccaactcttgggttcttgattccaagaacatcttccatatagatagatcccatctgtgcaaactgaagcagatattccgctttcgcatccatattcgctccagcatcgactaataacatcggacctttggctgttggcatcactgctcccagtggtgctctcttgatccctttgatccttccaacaacaaactgtcctccaacaaggatcgctcctgaacttccagctgatacaaatgcatctgcagtcttatcctttaccattttcagggcgaccaccatggaagaatctttcttcttacgaatcgcttctactggtgattcgtcacaagaaatttcttcttctgcattcacaacttcaatttgttcatttttatactgatatttgcttaattcttcatgaatccttggtgcttttcctacaagaaatactttcagattgtttttttcattcacagcatcaacggcaccttttacaacttctcctggtgcatgatctccacccatggcatcaactgccactttcactaatttctccatatgacctgttactccttttcttaaaaataggaaatgccacacgcctaaaccttcttaaaaagcctaaacgtatggcatttctcttcatttaccattattcagcgtgtgctgaaacaatttcctttttattgtaagatccgcaggctttacatactctgtgaggcatcataagagcaccacatttgctgcattttacaagtgttggagcagtcatcttccagtttgctctacgtctgtttcttcttcctttggatgatttattctttggacaaattgacattggttttacacctccttaaaattcttaaaaatatcctgaatcgctgccatacgagggtctgccaccgtacgatcgcagccacactctttttcattcagattcgttccgcacaccggacaaagtcctttgcagtcttctttgcataacactctggacggaagttttggaacaacttcatcgaagatcagtatatcaagatcaagatacttgtcctcgatatatgaagaatcttcttcatcgagatccgaaaaatctaattctttcatcacctgcacggaaaccggataactcacttcttcaagacatcggctacatggaattccaagcgtgacttctgtctcaaatgcaaatgatatcttatcctttccaatatttctaaaaacaatcgaaaaatcattcttctctcgaataggataagacacacctttaagcttaatctcattcagatcgattgacgcttcgacggtttcttcatatttaggtactgaaataatttttgataattgaatcttcatacgatctcctaaattttcatactgtactattatacgaatgtgcttctggtttgtcaagtaattttccttacttttaaaaaaacaatccagaagcacattttaacaagctttattttttatgaaatgattatttgacaagggctactgtgtctcttgcgatcattaattcttcatttgttggtacacaaagcagtgtaactttagaatcatctgtagagatgatcgctgtttctccgtgaacatcgttcttcacttcgtcaagttctgttcctaaatatccaagatattcgcagattgctttacgtgtgatatcatcattctcaccaagtcctgctgtaaatgcgatcgcatcaacaccattcatagctgctgtgtaagctccgatgtattttgctacgcggtatgcatatgcatctaatgctgcagctgcaactttgttaccttcagctcttgctgcttttacatctctaaagtcagaagatactcctgataatccgtaaactcctgattctttgtttaagatatttaatacttcagatgctgttttgttttctttattcgcaataaattcaatgattgctggatcaagatctccagaacgtgttcccatgatcagtccttcaagtggtgttaatcccatagatgtgtctactgattctccacctttaactgctgtaacacttgcaccgtttcctaaatggcatacaatgatctttaagtctttgatatcttttcctaagacttttgctgtctctaaagatacgaactgatgagatgttccgtggaatccataacggcggataccatcttcatcgtagtattttctaggaataccatataagaatgctttctctggcattgtctgatggaatgctgtatcaaatactgctaccattggaagtcctggcattaattcctgacatgcgcgaactccgatcagtcccgctgggttatgaagtggtgcgaatacgctgcattcttcaacttctttgataacttcatctgtgatcaggcatgattttgtgaatttctctccaccgtgaacaatacgatgtcctacagctccgatctcatcaagactttctacaactccgttttctttatctgtcagctggtcgataacgattccgatcgctgtcttatgatctggcatagctggtgtagatttgatcttgtcttttcccgctggctgatgtgttaatgctccatcgattccgattctttcacataatccttttgctaaaacactttctgtctctgaatcgattaactgatattttaatgatgagcttccgcagttgataactaaaactttcatgaactatgattctccttatatttttcttatttatctgcttccagtgctgctgcctgtacacatgtgatcgctactgcacctacgatatctgatgctacacatccacgtgataagtcattgactggttttgcgattccctgtgtaataggtccgaatgcctgcgctccacctaatctctgcactaatttgtatccaatgttaccagcatctaagtctgggaatactaatacattcgctttaccagcaacttcacttcttggagccttacttgctgcaacttctggtacgatcgctgcatcaagctgtaattctccacagatcaagtactgagggtatttttctttggcgatgtttgttgcttctacaacttttgttacatcatcatgttttgcacttccacatgtagaatgggataacattgcaactctaggtgttgctccgatcaactgctcaaatgtcttagctgagcttgaagcgattgctgctaactgttctgggtttggattctggttcagtccacagtcagcgaatacgaaacatccgttttcacccatatctttagcctgtgtatccattaacatgaaggctgatacaatctctgtaccaggtgcagtcttaacaacctgaagtgctgcacgaagtacgtttgcagaagagttgatcgctcctgctaccattccgtctgcatctccaactcttaccattgttgctccgaagaacagtgggttggataacaggatctcttttgcatcttctggaagcagtcctttgctctttcttgcttcacataaagattcgatatatgtatttaaatgatcacagttctctggatcaacaaaagaagctttggataaatctaatccttctgcttctgcttttgccttaatctcgtcttcttttccaactaaaataatatcagcgatcccttcactgataacctctgctgctgctgttaatgttctcatgtctgtagtttcaggcagtacaacagttttcttatttgcttttgccttgtttttaatctcatcaataacactcatttttcgcgttgctcctttcaactttccaaaaagatgaatttaatcttgttaaattatacaacatcatttctttgtatacaataatagtatttgtatttttcgttgtacatttccagaaaaatctatattctattctacatttttttgttttctctgacaagatacttgttgctcatttttcattttttgtgcaattttacttttattcatttgtgatttataatacatttacaaaataaacgattcaaataaggaatctcgaaaggatattttatgaaaacagcagctatcatttgcgaatacaatccatttcacaatggtcatgaataccatatcatgcagacaaggaatatcacgggtgcagactgcgtcattgccatcatgagtggaaactatgtacagcgcggaactccggcggttatggacaaaaaaatacgtaccaagtctgcccttcttggaggtgccgatctcgtgatcgaactccccttatttgcagcatgttcatctgcccctgattttgcaattggagctgtcagtctgcttcacaaactaggggtgatcgactacctttcttttggaagtgagtgtcaagatattaacaaacttaagcagatcgcatcctttcttatccaatataaagaagaaatcgagcatggtacaaaagagcttatgagtctcggacattcttatccgaaagcaaaagaactttatcttagagagcatcttgatgatacttctttgatcgaagtattaaaacagccgaataatattcttgggattgaatatttaaaagctttgctacagttagacagccctatcattcccgtctgtgttacccgtgtttcaaacgatcatcacagcaaggagttgacaccttcgatttcttctgcaacatccatccgtgaaatcttagaacaaaaccagataagccctttattctcaagagtccctgaagctttgcatgatatctatcagatgcattatcaaaaagattttcctgtctgcctggatgatttttctctgcttttacatgcagctatttattcttgcgaagatcttacacagatcagcggtatttcaagcgattttaaggaccgtatttttaagatgttaaaatctgatctttcttttgaagaactgatcagtgcctgtaagaccaaaaacctcacctggagcaaaataagcagaaatcttttgcatatcatgcttgatataacaaaagaaaaggttgaaaaagcacgaacttacgatatgtctccttattttcagattctaggtttcaaacgttctgcttccttcctgatcgggaatatcaaaagaaaatcttccatccctatggtccgccatctgcgtgttatgaatgatcctttatccaaagatcaagaagaattattatctacagaacaacgtgccaaccagttatatcgtaccgtgatcggacagaaatttcatacgatcataaaagatgagcagatcatcttctagtttcatctcccgcttcatacactataaaaagaaagcgggagatttttcatgaaaaccagttttatccagtttttacttatttttagtgttctttccttgttattttttccacaaacatcggtccaaggcgcaaaaaatgggctgattttatggtctgcaacgatcacaccgactcttttaccttttttactgctcactggttttatgcaatattaccaaacgttccatctgatctcccggctcttttaccccctcaaaaaactttttcctggtatcaatgaggactttttttacacctgtattctaggttttttttgtggatgtcccctcggtgcgaagatcattgatgattttatttcttgtggatcttttacgaaatctgaaggagaaaagctattatatacctgcaatcagatcagtcccatgttctctgctggatatactcttacattgatccttcatggcaaaatttctgctctgcgctttttcttttgcctgtattttcctgtcatgtgttatctgatctatctggtctttttattttttacaagcgattttctacatacacaccactcttctcccaccattgcacacaaaaaatcagcagatcaggtaatctttgatagtcttcattccattttcatgattggaatctgtattatgatcttttcaattgccgtttctcttttagaaattcttccacttcctttctatttaaaaagaggattgaccgctgttcttgaaatcacaaatgccatctcctattttggttcttcccatatgtctatcagccgcaaagtcatattattgtgtatgatcacttcttttggcgggttgtctgctgccgtgcagactttaagtgtatacaaaaagagcagactctccctctggaaatatctgctcataagatctctttttagtgtttcaagcggactacttgcttatctagtcttcatctgaaatgaaatcttctaccgttcttgttcttgcctgtggaatgctgactccggaaagctgttcttctatctccttcgcattcgttttaatcgatgcaagatctgaatctaatgcggataacaactggttaaacacactctcctgtgcttctttgacacttgccacataaccttgtacatcttccatgatctcattgacatagcgcaatgcacctgcacggatctgatctgcttcttcattcgcattatgtacaacacttcttgctgtatctttggcgtgagtttcaatctcattcgctctcatctttgccatctcaacaacctcattctgatcgatcaattctcctgcatctcttgctgcctgatcgatcatctgctgtgacttcactctggcatcttccaagatcgcatctttgttcagaatgatcttatggcttcgttcaatctcacctggaatctgcttccttaattcctcgatcactgtcatcaatacatctttctcgatcataatcttacctggactaaatcttgctggttttgcttcgtcgatcagtacttcaatatcatcaatcatctcatgtaaatacttctcactcatattcattcgcctcctatgatttaaatttcttctcaagacattcttgtacgtaaggcggtaccatctcagaaacatctccatgataagatgcaatttcctttacgatcgtggaacttacataagaatactcaatgctggttgtaaaaaacatggtatctaagtctttatccaatctcgcatttgtctgtgcaatttgaatctcatactcaaaatcagttactgcgcgtagtcctcggactgatacactggctccctgttgttttgcaaagtctaccaacaatccggaaaatgacataacctctacattatcaagatgacttgtcacttttcgtatcatatcaaccttctcttgtgttgtaaacattggtttctttgcactgtttaccaatactgcgatgatcagcttgtcaaaaaccttggctgaacgctctataatatcaatatgtccataagtcaccgggtcaaaacttcccggataaactgcaatactcatcttctaatcctccactgttttcatcaaaaatgtatgtttatttgtcttatattcttttactcttataacctttaatttctcaaaatctggtatctctgtgtcaagagacgattccacgataactaccgtatcttctgtacaaatagaggatcgatctatgattgataatacttcttcttcaaatcctttcttatatggaggatccataaaaatatgatcaaatgttacattcttcgtctctaactgcctgatcgctgaattcacatctgttgccagaacctgtgctttcttatcaagctttgtatatcttaaattctctcgaatgcatctcaatgcaggttttgctttctcaacaaaataagcttcctttgctcctctgctcaatgcctcgatcccgattcctccacttccagagaaaagatccagaaatgtacttcccgggatatcatactgaatcatattaaataacgtctctttgatgcgatcctgggttggtcttgtctccattccttcgatcgtctttaattttaaactcttcgcacttcctgctacgactctcatatctatgtatattccttgtcctttatttgctttgcaaagttattccacttttgctcactatttcttttattttattatatctacagattttgtcaaccgacaaaccaatatttcagaaagagacagtcaaagtttatactttcactgcccctttctgaaatcttatgatgtttgaggattgcttcattgctacgcaatttcgcaatccggatacatcatcttatctaattagcgagacatttcttcttcctgtctgcggatcattttacgaaccatctctcctccgacagatcctgcctgagcagttgttaagtgtccgttatatccttcttttaaatccacaccgatctcatttgcaacttcgaacttaaatctgtctaaggctcctctcgcttctggtacctcgactctgtttgttcctttgcttcttgctgaagttcgttcttccatgttgaaagtcctccatttcttttgttttgttatctgttacgctcatagtatatgcaagcgtacaaaagatacactgggagtttttacatgatgttgcattttatggattgttattttttgacacttacatcattttaataacgaacatgaaatcttttctcattttcttcatatggacgttcttctttctcgatctcatccactcgaacgaaacgatttcctgtctggatcaaatttaaaaatttctcaatttcaactctggttccctgaacttctgctgtcactgatccatcagacatatttttcacccatcctgtcaaatgacatctttctgcattcatcgctacaaaaaaacgaaatcctactccttggactcttcctgtaaatcttaaataaaaacgtaccatacgatatacctcctattatatattccttgcaagcccgatctgtttttctaatctgctgttcttcaaattcgaaaaatcaaatccgctttcctccagttgttttaccgcatcagctgcctgtttcataatatctgcattggtatagatatctgccagaacaaaatccatcatcccgctttgtctgactccgaagaaatcacccggtcctcgaagttttaagtcttcatttgctatataaaatccatcatttgatttattcaacacttcaagacgctgcatcgtttctttcttcttggaactcgtcataaaaatgcaataggactgatagccgccacgtccgacacgtcctcttaactgatgaagctgtgcaagtccaaaacgttctgcattctccaccatcataaccgttgcatttggcacattcaccccgacttcaacaaccgttgttgatactaaaacatcaatcttgccttctgaaaaatcatccatgactttctgcttgtccgctgccttcatctttccatgaaggtaactgatccttaccgatggtgcaaattggcttcttaacatctgcgcatactgaatgacattttctccttccatcgtctcactttcttcgaccatcggacagataatatatacctgtcttccctgactgacctgtttctcaatgaaacgatatgccgtcgggcggtaacttgtgttgactacgcagtttttgatcggcaaccgctctgccggcagttcatcgatgatcgatacatcaagatcaccatataaaatgatcgccaatgttcttggaattggtgtcgcactcataacaagtacatgtggtttctcaccttttagcgataaactttctctttgtcttactccaaatcgatgttgttcatccgtgataactaatgctaacttgttatattccaccttatcctgaatgaccgcatgagttccgatcacaatatctacttctccatctttgatcttttgataggtttctcttttttcttttgcctttgtggaacctgtcagcaatgcgatctttatatcataagattctaaaagttctgtaaatgattcataatgctgagctgcaagcacttccgttggcgccatcaaaaccccttggtatcctgctttggcacacattaataataaaataaccgcaaggatcgtctttccagatcctacatcaccctgtaccagacgattcataaccttaccagacgccatgtcttttgccatctcatttaacgctcttttctgcgctgtagtcaattcatatggaagattctttaccagttctttcgcttccttgcagaccccgatcttgtatccttcttccttgagatcttctcctgatgtgatcatatgcatcgctgcgataaaaataaaaaattcatcaaagatcaaccttttctttgctttgatcaactgctcttttgattccggaaaatgaatattccagattgcctgatgatattccattggctgatattgatctaaaatattttgcggaagatattctggaatatgaaagatatagtcttttgtctgtgccacagccttagaaacaagtttattggtaagtccacttgttaatggatatactggctgcaatgtctcctgtttagcttcataatcttcctgtgtaaagatctctggatgttccatcgtgatccgtccatttttatagatcggagttcccgtaaatatataatctcttccctgatgtaattgtttctttaaatatggcatattgtaccagacaagcatgatcgttcctgtatgatctttcgctgtgcatgtaacaatcttcattctttttgcatactgaatatgaacttccgaattgatacgaacgaaaatagatactctctggccaatctcgatctcattgacatctttgggatcttcataggtaagataatactttggatacatcgtgatcagactgtctacatcacggattccaagtcgtccaaaagctgtcgcactcttttccccaattccttttaattctatgatatttgttgtgccatccatcttctgtctccttcaaaattctttatcatattctcacgaaaagcaaagaaatcccgccatcaagcgggatttcccatcttctcttattctactgataataagaaataataaattggctgtccgccatattctaactgtacatcacagtcaccatatgtttcttctactttctcaagtaatgcttctgcctgttctttggttgtgtcttctccatagtaaatactgatcagttcgctgtcttcatctaccatctcttctagtaattctaacgtgactttctcgacatcctgtccgactttcttgatcccatcatcatcgattcccatgatatcatcgaccttgatcgtaataccattgatggatgtatctctgactgcataagtaacttctccagtcttcacgcattcaatgatgtctttcatgttgtcttcattctcttcggcatctgcttctggatcaaatccaatgatcgctgagattccctgtggaactgttgttgtcggaatgatcactacattcttatcttccactaaagactgtgcctgtgtcgctgcaagaatgatattcttgttatttggcaaaataaatacagtctctgcattcacctgctcgatcgcattcaacatatcttcagtactagggttcatggtctgcccaccttcgatcaggtaatctacacctaactcacggaaaatatcattcattccctggccgatcgatactgccacaaatccaaagtcttttctaggttcttctggtttgctttcttctgcctgtgtgagatttaaacgttctctgtgttcttctctcatattatcaatcttcatattcgtaagttctccatatgtgagacctttctcgatcgcttttccaggatggtttgtatgaacatgtactttaatgatatcttcatctgcaacaaccacgatagaatctccgattcccattaagaaatctttaaacttctgttcttcttccatggaaatctcttctttcgtcataacgataaattctgtacaataaccaaatttgatatctttctcttctaatggtgcttcacttgctgttgctgctggtttaactgctgtcttctcaacactgcttaaatcaacttctttacccattaaagcatcaacagcaccctgtaggaattccacaagtccctgtccacctgaatcaaccactcctgcttctttcagaactggtaacatctctggtgtcttctgaagaatctcgtttgcttccttgatcactacctgagcaaattcttcaaaatcttctgtattccttgcacaatatactgccttctctgctgttactttcgctaccgtaaggattgttccttcctttggtttcataactgctttataagctgtctctactgccttcttaaatcctactgcaacagtttctgttgttaatacgtcctgatctttgacacctttataaaatcccctgaataactgggatagaataacacctgagttacctctggctcctcttaaagaaccgcttgataatcctcttgttacttctttcactgtcacttctgctgcgttcccaacttctttagcagctgcaagagctgtcattgtcatattcgttcctgtatcaccgtctggcacagggaatacattcagttcattaatatattctttattcgcctctaatctcttggctccgccaatcaacatcttctgcagcaaagctgcatctatctgtttcatcttaatctttgcctccattatctattatcctatatcctttacgccctctacgtaaatattgatccgttctacttcaaggcttgtaaattcttctacacgatactttacagattccataaggttacttgccactgtagaaatagaaactccataagatacaataatatggaagtctatcgtgatcttattattctttacagaaacaaatacaccttttctgatattatctcttgttaacagcttggcaatcccatctttcatattcaccattgccatccctacgataccaaaacatccaagagcacagattccggcatatttcgcaattacctgattttcaatggaaatctctccattctttgtattcacatgtcctttcataaattatacctccaaacgagaattcatatatttcgattatacattatgaaaccacctaagtctagtgtttcaaaaaatgatttaaaataaaagcaaatttattcttgatttttataaatcaatctgttagaatgaaatagttgtcgagcctggaatgaaacaggaatagagattggaataaggaggtgctaacatggcaaaatgtgctatttgtggcaaaggtgctcattttggaaacgcagtgagccattcacatagaagatcaaataaaatgtggaaatctaacatcaaatctgttaaagttaaagttaacggagcagctaagaaaatgtacgtttgtacttcttgcttaagatctggtaaggttgaacgtgcttagtcttgattgatcatataagaaaccactaagagttggaatttattccaactctttttttattcttcaagcgttatttaaagaatagacagtaagctgtgatatcacatccgatacagataactattttcatcggatcgtgagtgatccagaatcctgtaaataagcccaatgagaaaaagaaaaaagcgatggcccagactcgtttcatatttgaagatcctttttgtacatatgtattccaaaattctggtttgaatgacggaaattaatggtggaatattataaacatctatctaccactccaaaaattgaaaactaataatgtttaacatacacacctttccgtttgaaaattcttaattttataaaagaatgtcttcaggtattcataaaaacataaagaaagatagaggtacgaaatgatagaattccatagaattcgtttttcgtagctctatctttctttatgtttttatgaatactcaatacatttctgttagacaatcaaattttacttttcaagatcatccacaatatcttctaatgtctcattcttccccgtaaacttatcgatcacatctggtaccatatccagtaatttcacaatcgtttcctgattcttaatattcacaagtttcgtctgtccatctttaatgacaagaactgcacttggagtcatctttcctccgattccaccaccgctcttgtccttcttatcaccagagaaagctcctgctcccattccgaaggagacatcaactaatggtaagatgatcgtatctttgatgtagattggttctcctacgaccgtttttgatgttaagaatccttccataccgtcaaatagtgaacccatggtatcttttaaattttctttgctcattttaactgcctcctatcattcttattgctcggtctttttgtttgatcaattcatctttatctttatatactttccataacaaatataagatcttgtatcttcggatccttcctttgatctttagctctcctttcaagattctcttctcaaaatctggtgtgatattgatatgatcaccgtagattggaatcaatgcagcggtccagcctaagacttttcccgtgtaatatggatcttcgaatccaaatataatctttgcatttagtttctgtggaagtaacagctttaccccattcactccatatctcttgattcgcttcactgcatcaatgatatcctcatcttccaatagatctccgatcatttccatcttatttgtgatcttacggatctttgttatgaaattcttgcatctattataacattttttgagaaaattcacgattcttttgccaaaaaactctttctctttatctgttgttttgtctatcttagattctgatatcttatcttctgatctttcgtacatttttcttgttgttgatgtctttgttctttcttctttttcatcccatgtgagattaaatacatcttcatcttcagaaggatatgtactttttttcttttctactcgtttcttattgttttttttatttttttgtttctttttagagtctgatcttttcttatgttttttcttatctttctctttatgctctccaaatacagaccagtgttctttccttgaatcataaatcggtattccaaaaatcctgattccaaaattcagctcttcttcatagaatgcttttgcacgtaaaaatataactgcccatgatacttttacctgtgctttgggactcttcccatcaaaatctccttcgatctgataacagatcgggaagatcaaaaggatcaacaataacacgatcggtatcaggatcaggattcctatgatctttaatattaaaaatagtatactcatttatcttccccacaaaaatatgttgttacatcctcaagttctcctttatgatacagatcattgatcatgcgtcttaacataacaactgcatcatctcgtcctgctgccattcctacgatcgtgatatcttttccttcgtggatatcggataatagttcattatatggatatatttccagaaatgcactgttccagagcggcagtgtaatacagtacaatcttgaaattgatttcttttcttgtattttacaaaatagacgtttcttttgtaattttaatatctctgatatgtatacacgttctgaaactttcactcatttttcctcctgaaaattctccccattcattcctgataaaattcctgataaaacaaaaagggatgtattactacatccccattttaacatatattgttgtcgattactcgccaaattcgccgatttttacaactttcagcatgtttgtaacaccttttccacgatggttagctggtccaccacctgttaagactaagatgtcatctttctcagcaagtcctgcatctaatacgatatctgttgcttcatctaacagatcttttgttgtctcagctttgtgagatttgaaaggacgtactccccaatagatctgcatctgacgtacgatcgcatcatctggtgacagaccgatgatctgtgcatctggtttgaatttagatacgattcttgttgtgaatcctgacatacttgatgctaagatacattttgcatttacattgtgtgctgtctgtactgcagaataagcaactgctgctgaaattccacgattgatatatttagatctgtaatctttgatctttgtgcttaagtgaacttctgttgagattgcgatctgattcatcatcttaacagcttctactggatatttaccttttgctgtttctccagataacatgatcgcatctgttccatcatagatcgcatttgccacgtctgtagcctcagctcttgttggacgtgggttacggatcatagaatctaacatctgtgtagctgtaacaactggtttgaatgcatcgttacattttctaatgatctctttctgtaagaaaggtacttcttcagcaggtacttcaacaccaaggtcaccacgagcaaccatgataccagcagatgcatcgatgatcgcatcaatgttttcaacaccttccatgttctcgatcttagagattacaccaacatgcatgttatgtgcaccgatgatatctttgatctcttctacagcttctgcattacggatgaatgatgctgcgatgaagtcgattccattctcaagaccgaattcgatatctgctttatctttttctgtgatagatggtaagttaactcttacgttaggtacgttaacacccttacggcttcctaaaagtcctccgttgataacgtcacatacgatatctgttccatctttgatctctttaacttttaactcaattaatccgtcatcgatcaggattgtgtttccagcttctacatcctgtggaagttccgcatatgtaatgctggtaatttcattatttcctttgatgtctcttgttgtcagtgtatattcctgacctgttactaattcaacatcatcatctgtttctaataatcctgtacggatctctggtccttttgtatcaagtaaaatagcgattggtaaattcagttcttctctgaacttcttaattctcttgatacgtcctaactgctcttcatgatctccatgagagaagtttaaacgggcaatgtccattcctgaacgcatcaggtcttttaatacctcatcgtcgtctgttgcaggtcccattgtacaaatgatttttgtcttcttggttagcataatttttctcctttggtttcaaaaatatatttaaataataaacaactcaccttttcacatgcttatgggtaaataaatgatcttgacaatattcataattcccatcgcattttgaacaataacgaaattccaattctggatcgtcaagttctgttctgtggcacactgcacattcgtgcatcgcaccattcttcttctttggcgtgatcgtcttagctttgtacgctctcgccttcttcttatgtattgttttagccttgaagtttgctcccattcttcgaatcttcttcatagagaagaaaaatagtagaaaatttaacaaagctgcaactatagatactttaaccgaaattccggcaactgtaaagcctgaacttaaaaaaatgtagattaaatataatccatctaagtatccaagccattttaccttgattggaaggatcatatacaaatatacttccatctctgggaacatagacgcatatgctaaaaataacgtcatgttcagataaaaagtatccatgttaacaaacgctccatagccttctccatatgcgaatgtaaggatcgcataagttaaaaatgccccaacgatcgttcctaaaactccgatcagataatacatattgaatcggaatgttccccatacctgctctaatgagcttccgatcgagtaataaaataacaatacaaatattacaaagatcaaattcgtctctggtccgatcaacaggaatgtcacaattctccagacttgtccatgcaagatcagatacggattcaattccagtaaactatataatcgtggtgatatattggcgatcacaaaaccgactgcatacaataaaacaatgatcttagggagattcggtatcgcatatctgccaaacttctcttccagtttattaagccacataaaaaacctttcttatcatcaaaaattaaaacatatttttctttccaaggatatatcctccaaagatcgtaaggatcaaggatacgatcacaaggatcaaaaatccatgtgctgaatgtgccagtggtactggaacattcattccccagaaactcgcgatcatcgtcggaatcgacataacgatcgttatgatcgcaagaaccttcattacaatattcaggttgtttgagataacggatgcgtatgcatccatcgtaccacttaagatattgctgtagatgtctgccatctcaatcgcctgtttattctctataataacatcgtccagtaattcctcatcttctggatactgtttgatcttatcaatctttaacatcttctcaagcaccagttcgtttgatctcagggatgtagagaagtaaaccaaactcttctctaattccagaagctcgatcagttcctggttctttgttgaaatatgaagctgcttctcaacagaatcactcttcttatcaatgattcgcagatactgcagatacaaggatgcattccgataaaggatctgcaagataaatcttgtccttttaaatgtccagaaatttcgaacccttccattcttaaagtctgctaacactgctgtatcttccagacagaccgtaatgatcactttctctgtcaggatgataccacatggaatcgtcaggaagtattctttttcctttctctcttctgttgtcggaacgtctacgataaataaagtataaccttcttccacttcgatatgagaacgttcttcttcatccagtggtgctcttaagtcatctatatcaatcttatagtctgttgcgatcttcgcaagttctgcagctgtgggatgaattaacgatatccaggttccttccataggttcactgatttcatgaatctggtgatccatcgtgcgataatacttgatcattgtccgctcctttctatggaagtaccttgtccataagttccccacaaacaggactctatgaatcctgttttatcatctgaaatatctaaaattccaaacttttacctattccattataaataactcattttgctttgtcaattaacagtactgtaccaactggaagtgttaactccctaatttttttgttactttttgctaaattttccactgttgttttgtgcatcttggctatatcaaggattgtttctcctttttttacaacatatggaatgaaagctccttcgatcacgttcgtaaatccaggcacacataattcatctccaatctgtaaattatatacatttacaaaaggattttgtctcatgatatcttttaccctgacaccatgtgctttcgcgatcttatataaactatccttttcctttacaacatacactgtccctttacacgaatttgtctgcatcattcttggcattccttcgctttttttatagaatatgcagcagcattcccttgtttccattattttctccgatttttttagataatattcctatttgcaattattttgaaaatgattataatagatataatgtccatgtatattggacagatatgtttttttaacattattttaacgcttgaaattatagtacttttatagaaagcaggtatacgagaagatgaaacgattaggaattgatattggctcaacgacagtcaaggtcgctgtcatcgacgaacaacataatatacttttctctgattatcagagacattttgccaagattcaggaaactttatcttccttattaaaaaaggcaaaagaccagattggggaaatgacatttgctccaaccgttaccggttccggaggactttccatttcttcttacttagatattccattctgtcaggaagttgtctgtgtatcaagtgcacttcaggattatgcacctcagacagatgttgccattgagcttggtggtgaagatgctaagatcatttatttcacaaatgggattgatcaacgtatgaatggtgtctgtgccggtggtaccggatcatttatcgatcagatggcctctttattacaaacagatgctggcggattaaatgaatatgcgaaagattatgatacgatctatccgatcgcagcccgctgcggtgtattcgccaaaacagatatccagcccctgatcaacgaaggtgctacaaaaccaaaccttgctgcctctattttccaggcagtcgtaaaccagacaatcagtggtcttgcatgtggtaaaccgatccgtggaaatgttgctttcctcggaggacctcttcatttccttacagaattaaaagaagcatttatccgtacattaaacctaaaagatgatgagatcatcgctcctacacactctcatttatttgcagctgtcggtgctgctctgaatgctaaagaggaagttacaactgattttgaacatcttttaaaacagtttgagaagaagatcgaacttcagcaggaagttgaccgtttagagcctttatttaagagtgaacaagaatataaaaatttcgtaaaagatcataaccgtcatgttgtgaaacgtggagatcttgctacatataaaggaaattgttacttagggatcgatgccggttccactacaacaaaagttgctttagctggtgaggatggagaacttctttacagctactacaataacaataacggaagtcctcttcacgccgttgttgaagcgcttcatgagattgacgcacagatgccaaagacagctaagatcgtatcttcctgttccacaggatacggagaacatcttgtaaaagctgccttaaatcttgactttggagaagttgagacgatcgcacattactatgcagctgcattctttgatcctgatgtggactgtatccttgatatcggtggtcaggatatgaaatgtatccgtatcaaaaatggagttgttgatgatgtacagttaaacgaagcatgttcttctggatgcggttcatttattgaaactttcgcgaaatccttaaatcattctgtacaggaatttgccaaagttgctttaacagcacagaatccgatcgatcttggttcacgttgtacggtatttatgaattctaaagtaaaacaggcacagaaagaaggtgcaactgtcggagatatctctgctggtcttgcttattctgtaatcaagaatgctttatataaagttattaagttaacagacccatctgaccttggaaaacatatcgttgtacagggtggtacattttataatgatgcggttcttcgaagctttgaacgtatctccggatgtcatgctgtaagacctgatatcgcaggtatcatgggtgcctttggttccgcactgattgcgagagaacgttacgaagatggtatggaaacttctatgcttccattagaagaaatctttgcgatgagtgttgatacttccatgacacgatgcaaaggctgcacaaatcactgcctgttaacgatcaataagttctctaacggacgccgttatatcactggtaaccgttgtgaacgtggtattggaaaagaaccgaatgctgaaaatattccaaacctttacgattacaaacttcatcgtacctttgactacgaacctttatctgatgagaaagccactcgtggagtcattggtatccctagagttttaaatatttatgagaactatccattctggtatacattctttacagatcttggatttaaagttgtggtatctcctgaatcttctcgtaagatttatgagttaggtatcgaatctattccaagtgaatctgaatgttaccctgcaaaattagcccatggtcatgtgatgtggctgatcaaacagggaatcaaggatatcttctacccttgtattccttatgaacgtgacgaaatggaaggtacaaacaaccattataattgcccgatcgttacttcttatgcagaaaatatcaaaaataacatggaagaacttgcaacagagcatatcaactttatgaatccattcttagcactggataatgaagaagctttaaaatcccgtttatttgaggaattagaagctcagtatcatttgactgctgacgaaataaatcacgcggttgataaagcttatgcagaactttcacaggttcgtacagatatccagaataagggtgaggaagtccttgcttaccttgctgaaactggcagaactggtatcgttctatgtggtcgtccatatcatatcgatcctgagatcaaccatggtattccagaattgatcaactcttatggaattgctgttttaactgaggattctatttctcatttatcaaaggttgaacgtccattaaacgtacaggatcagtggatgtatcattccagactatatgctgcagcaaactatgcaaaagcaaataaacagttagaagtcattcagttaaactctttcggttgcggactggatgctgttacaactgatacagtgaaagatatcttaacaaaatccggacgtatctacacagtattgaagattgatgaggttaataaccttggagcggcaagaatccgtatccgctcactgatcagtgctgtccgtgtccgtaaaaaacataagatcgaaccaaaacctgtatctccagcgatcaaacgtgtggaatttacaaaagagatgcgtaagaactatacactgttagttcctcagatgtctccgatccattttgaattcttagagcctgctctgcagtcttgtggatataacgttgaagttttaaatcagggtggtatggaagatgttaacacaggtcttaagtatgtaaataatgatgcctgctatccatctctgatcgttatcggacagttaatgaatgcattgctttctggtaaatatgatcctcataagatcgcacttgtcatctcccagactggtggtggatgccgtgcaacaaactatatcagttttatccgccgtgcacttgaaaaagctggttacggttatgttcctgttgttggtttaagtgcccagggaatcgagaaaaacagtggatttagctttacacctggtttattaaacaaagcagttcaggcgatcgtttatggtgatgtctttatgagaacggtttatcatacacgtccttatgaagtaaaacctggttctgtcaacaaattacacagacaatgggctgctaaatgtaaacgtgatattgccaaaggtaacttctatacattccagaagaatatccgtggaatcattcgtgacttcgaccgcattccattaaaggatatcaagaaacctcgtgttggaatcgttggagagatccttgttaaattccttccagacgcaaacaatcacttagtagagcttctggaacgtgaaggtgcggaagctgttgtacctgatctgttagacttcttcatgtacagcttctacaacagtaacttcaaataccgttatcttggtaaatccaagaaatctgcgatcgtcagcaactccgcaatctgggttgtagagcgttaccgtcagactcttcgtaaagagctagccaagagtaaccgttttgagccgcctgcatatatcaaagaccttgcagaatatgcaaaaccattcgtatcaatcggtaaccagactggtgagggttggttcttaacaggtgagatggttgaactgattcacagcggtgctccaaatatcgtatgtacacagccatttgcatgcttaccgaaccatgtcgttggtaagggtgttatcaaagaaatccgtcaggcattccctgatgcgaacatcgtggcgatcgactatgatcctggagctagtgaggttaaccagatcaaccgtattaagctgatgctttctgcggctgagaagaatatgaataaatagttatttttctattgtttagaatcaaatgctaataaaaagaagccatgttccggcatagataaatcttgtctatgcttgtaacatggcttcttgtttgtttctttctatttcaattagatcattctgctaaaatttcttccagaatggctgttgcatcttcaatgcagcctggacaggatcttaagacttttcccgtttcaatcccttttaggtccttacattttgttgcttgattcttctcctgaaagcgttttacaagctctcctgttagtttataggttgctgccttggaaactggtttctcgatgtctccacagctttttatggcaccgatgactgcaacggctcctgtgatcgctccacatgttccttccatgcagcccatacctagtccatggccttccatcatcttgaaaatgatggattcgtcgatttccatttcttcagcaaatgcacaggcaactgcctgggcacagttgtagcctttctggtggttttgtgctgctttgtctgttttgatactcatttgtaatgtcctccgatttttattcattattaattagattgtagatttcttctgctgttttgtctggatgttgttttacttgattgtagattggtcttatcttggttgttgactcttctagttcatctgctatttgttctagattcttgtttttctttacttttttctgaatcatagaaatttgatttagtaatttccctgcccttaccccacgattttccgcactctgcagctgacttactctatcactcgctgccatcgcttctcttaaatatagatatctgtcccgttcgtcctggctcatctttaccatttcttcttgtatcctttccatatatctattacctgctgattcctgcgcaacctcttcccatgtcgttgctgcgatcagtcttgcccaacggtatagagggtgctttcttgctttgcctttggttgtcttggttttctataattctacttctttccttaattattcatactattttgaatacatcacatcatttttcgaaagtaaataaacacagtattgattcatactaattccttctctctgtgaatgttctgctaatgatctgtgtagacttcgtggtattcttaatttgaattgtccagaataattttccaagctatctggttcataaatttctattccctcttccaatgctgctctgatccactctctttttgcatcttttgcattctgcattgcactctctattgtttctccacatgtaatacaacctggtaaatcaggataagatattacaaacccaccttcatcttgatcttctatgatttccatcttatatgacatactcatatactcattcagcgttttcattttctctttcctcgctttctacaacctttcttaccatttctacatatacttttttaattggttcatgctttggtattgtaattggacttttcccttgttttctaaatgtataatgactacttccacttcttggggcatccatcctatacccataagtttctaataccttttgtaattgtgtaaatcgaagatccttcgacaaattgcaaatacgtgcgattagtttatcccattttgacatttgtatcttcctttcttttattatatttggtgtcgtatttggtgtcaatattttatttatgtaaatatttgtattttatgtaattaaaacacattcgcttattcctgtcaatattttacaataacattgtattaaaaaagaagactcctcacaaaaaagagtcttctttccttatcatcaaatgatgtaattctatcttctgacactgatccctctctgatccagatattccttcagatcagatatcttcaattcattaaaatggaacagtgaagccgccaatgctgcatctgcttttccttctgtcaatgtatcataaaaatgttctttattccccgcaccaccagatgcgatcactggaatatcaacattctctgcaatgattcttgtcagttcattgtcatatcctgctttcgttccgtcacagtccatgcttgttaacaggatctctcctgctccgcggcggtttgcttccatagcccattctacagcatctaagcctacatcgattcttccaccgttcttgtatacattccatccgcttccgtcggctctgcgtttggcatcaatcgctacaacaacacactggcttccgaatttgtctgcagcatcattaatcagatctggggtattgatcgctgaggagttaatggaaatcttatctgctccttctcgtaagattgccttaaaatcatcaacggtacggattcctccaccgactgtaaatgggataaataccttttctgcgacttttcttaccatatcgatcatgatatttcttgcatcggatgatgctgtaatatctaaaaatacaagttcatctgcacctgctttgtcatatgctgctgcgatttctaccgggtctccggcatcgatcagattgacaaaattgacaccttttacaacgcgtcctgctttcacatctaagcatgggataattctctttgtatgcatagccaattcctcctatagtgaaacgaagttctttaaaatctgtaatcctacggtgctgctcttttccggatggaactggcaagcaaagatgttgtctttctctactgctgcgtgaatcttcacaccatattcggttgttgctgctacaatatcttcatcgtctgcctgaagatagtaagaatgtacaaaatatacataaggattctctggcagtcctttgaataatcttgaatcttctttgactttgatattattccatcccatatgtggaatctttaaatctccactctttggaattcttaagatctttcctggtaataatccaagtcctttgactcccggtccttcatcgctggattcaaacatcagctgtaacccaagacagattcctaaaaatggaatattcttctctacaacttcatggatcgtttcttctaatccataatgacggatcttctccatcgcatctgcaaatgctccaactcccggaagaatcactttatcgctgtttacgatctcatcgtgatctcttgtgatgattgcttcttctccaagataattgagtgctttttcaacacttttgatatttcctgcatcataatcaataatcgctatcataggtgcctcctattcgtgtgctatgtttaaaaagtcacggctgtccatcttgatccctattcctttttctttgatctcttttccgatctggtatagtgaatgatgaactcttacgaacgttgctttctcattgtagaatgccatcttctcaaaaggccagcggaacaaacttggaacttcaaaaccttctcctaattctaatataaaaagctttttatttaaagtgttttgcagccattttgtgtaacttgcccatgaatttaagtaagctccttcgatatagatagattttgtctcttctgtgcggacattaaagatcaattgttttccacattttgggcattccagatgttcgatctttcctgttttttcataatagtcgatcaaatctctaagtcctaagttcgcaggatagagctgctcatcacatggtgcactgcactggaagaaatttccatttccacatggtgctgtcacgtgatctttctttaaatgggtatgatacaataatccatcatcgttactcgtcactacgaaatattcttttccttccaaaacttcttctaattctttaaacagatctgtctctttcatggataataaatactctctctcgtaaacagttctcatccatttggaatcttcatcttctttatcgatgagattctggtaatgttcatttgtgatcgctttcttgaaatcgatcacacggtctgcacgcaattctcgtccgatccccactaatacaaggtctgcatcctgaatctgttctttgtaatcttttaacatatttcttttcatcctttttatcctattatccaaaagaaaccagtttacactgatttcttttttgcttacactatttatctatcataccacaaaactcatttctttgtctgtagcatttttacttccatacacaacacaatgaaaatgcttttttaacattgtacagattcagaatccgcagattccacatcaaagtaaaattctacaccaccttctacattggcaactccataatctttgccatgtgctttcatcgttgcttctacgatagacaatccgattccgcttccaccgtattctcttgttcttgctttatcgactttatagaattttacccacaatttatcaatatcttcctgtggaatatggtctcccgtattaaatactttgatcctcacgtcatttccatgacgacaatagctgactttgatgattccaccgtctgtcacgtgatttctggcattgctcagatagttgttcacaacttcttcgatcataaattcatctgcccacacatgagtctctggctcatcaaatatgatcttgacttcttgcttttccacaaggatcttgcttgattctaccatattgcggatcatttctgtaatatcaaatcgttccatattgacctgactatttccgaattcaatctgattcagtgtcagaagtttctgtaccatacggttcatcttctttgcttcatctgcaataacgtcacaatagaactctttgctttcttcatcatctaagatattgtctttcaatccttccgaatatccctggatcagtgcgatcggtgtctttaattcatgggatacatgggataagaattcctttcgcatctcatcaatctgaactttctgctcgatatctttttgcagttcattgttcgctgttttcagttctgaaatggtgaattccaatttagatgataactcattgatactggctccaagtcgtcctaattcatcatcagatcctgttggcactttcacatcaaaatctaaatgtgacatctgattcgcggccttggccatatcttcaattggtcttgtaaactggcggctgtataaatacatcgcaactgcgccgcaaatgatcaagatcagtccaacatacatcgtaaactgtccggataatctggcacttgtctggatactttccatcggtgtacttatgatcactgtataatcaccatccagatagcccattagattgatgcttgttcccatactcttattggtattggtcataactgcataaccttgcttcttgatctggttactgatcttatcaagattttcatttaaaatgttccaaaggcttttatacatcaagctcttctctccttcagaactataaacgatcgttcctgatccatcactgatcaaaaccctgtaattataagtcttcgcgatctcatccacatcattcttccgtaccgtatctttttgaaaaactttctgtatctggtaataagattctttgatcgtcttcttttccttcacagtataatatgtcttcaacatagtaagattgatcagtactgataataagattaccgacgtcatgatgatgatcagcatcaatgtcatcttgactctgactgaacggttctttaataatttctttctcaattctcttcaacctcaaatttgtatcccattccccagatcgtatgaatataagaacctttttcaccaagtttatttcttaatttctttacgtgggtgtcgatcgttcttgcatctccaaagtaatcatagttccacacctgatttaagatactttcccttgtaagggctcttccttgattggacataaaatactgtaataattcaaattctttgtaactcagattgatgctttttccgtcaatagagacatgatgtcccccaacatccatgacaattccgccagcttctatctgttcaccttctgtctgaaccgttcttcttaaaatggcttccactctggcaaccaagatctttgggctgaatggtttggaaatatattcatccactccaagttcaaatccaagaagttcatcttgttcctgatcttttgccgtcagcatgatgatcggaactttagatactttacggatttctttgacaacttcccatccgtccatcttcggcatcataacatctaatactaacagattgattccctttgtagaataaaatgtatcaaccgcttcttcaccatcctgtgcttctaacacctgatagccggctcttgtcagaaagtctttgactagctttcgcattctgctttcatcatccacaactaatatctttaattcattcaccttgcatcttcctcctaatcttattttctcataccatttatttatatttctttcctataaaaaagaaacatccttcttattttgttgactttattctatcataggattatgtcaaaactgtgaatgtttatcatgaatttacgatcatcatctcttcacaaaatatatcaaaaaaagaagtctcacagataaatttctgcaaaacttcttttatgatcatgatacttttgtatcatttaattgttcgtattattctgcaatcgctttgatcttctcaagaccgaagacaatcacgataccgataataaagaatattggatggaacgtatgaagtgtcatcgctgcttttgtattctccagtgttgttggtcccataacgatcgcatataaagaaccgatcatcattccgataacaaaatagatcatcgcacttctatggttctccaatgcacggcggatcagtttgatcacgagtgcgattcctgtcaagattccaagtccaaagatcactatgactgggaagtaagacaaatgaagatgcatcacttctttgagtgctgtgatcactggaacatataacccaaagatcagaagcattgttgatcctgaaattcctggaagtaccattgctgagattgctaccatcgctactgcgaagatataaacaaccaatgcgatatttaaatgttccacgctaacactgattccttttccagatactggattaaagtatgtgattgctgcaacaagtacaactccaatcactgcccagatgatattctggtattttccttttaatgaatctttctcttctttgcagatcatcggaattgcaaaaatgataagtcctaagaataaagaactgatctcataaatcctgtcatcaaaaatacttgccagaacagaaactgctgctcccattccaacgacccatccaatgccaatccttattaaaaacttaattgcttcaattctttcttcttttgttcctgacatcaaataatcgagtgacatgataaacttgtcataaaaaccaagtaagaacgcaaccgttccaccagatacacccggaacactatcagctaatgccatacaaaatcctctgataaaatttagcatactacctctttctcctgttatgtgtttaatatacaacacattgtattgtaacataacttttttttagaagaaagtatgaaataaaattcacatattttcatttgctgcacgaaggatcgtagcccctccagcaacaatgtctccatcatagaatacgactgcctgtcctggcgtgatcgctctctgtggttcatcaaagacaactcttacttcatcttcccctgtcatatagactctgcaagggacttccggactattatatcgaatcttcgccatcagtttcataccatcttcaaactctggtacagacatacagtttactttatttccatataaaacattggcaaacagatcctgtttgtctccgactacaacttcattcgtatctttgtctactttgatgacatatcctggtttcttcaaggataatccaagacctcttctctgtcctactgtatagtaaatgatccctttatgctctcctaagacattgccttctggatctacaaatttcccttttggaatctttgttccagtcgtctcttcgataaattcgccatagttatcatctacaaagcagatatcctgactgtcaggcttgttggcaactaacagtccgatctcttctgcgatctgtctgacttcatcttttgtgtatgccccgatcggcatgagtgttttagaaagctgattctgagtcagattatataatgcataggtctgatctttcttctgtgtcttagaacattttaatgcataacgtccgttatcaagctttgtgatctgtgaataatgtccggttgcaatatagtctgctccaatgtctaagcaacgctttaataaggactcccatttcacataacggttgcatgcgatacatggatttggagttcttgcatttaaatattcttcacagaaatagtcaatgactttatctttgaagtcttttctaaaattcatgacataatgaggaattccgatcatctgtgctacacgccttgcatcatcaacagctgatagtccacagcatcctccattctcttcctgaacaaactcatcttcttcctgccagatctgcattgtcacaccgatcacatcgtatccctgtttctttaagagatatgccgcaacggatgaatcaacgcctcctgacattccaaccacgactttttctttcacaactgcctcctagtattcctcttcttcttcaccttcactgatatctgttttaggtttttctaatccttcgatcttgataccatttttctcagcataatcccataatgctgcgtgaattgcttcttctgcaagtaaagaacagtgaactttcactggtggaagtccatctaatgcttccataaccgctttgtttgttacttctaatgcctgctgaatgttctttcctttgacaagctctgttgccatactgcttgttgcaacggctgctccacatccaaatgtcttgaatttaacatcctggatgattccattatcatcgatatctaaatagattctcatgatatctccacattttgcgttaccaactgttcccacaccactggcattttcaatttctcctacgtttcttggatgctgaaaatgatccattactttctcactgtacattatgattcctcctgatcttatctataaattctactgaaattttattttcattattttcctctatggaaaacctcttaattatttttctttacaaaatcttcatataatggtgacattgttcttaattttgtcacgatctctttgatattgtctacaacataatccatatcttcttttgttgtttcttctccgatcgtcatacgaagtgatccatgagcgatctcatgaggcagtccaatagctaacagtacatgagatggatctaaggatcctgatgtacatgctgatccactggatgcacagattcctgccatatcaagcatgatcagtaaagattctccttcgatgaactggaaactgatattgatgttgtttggtactctcttttgtgcatctccatttaaacggcagtatggaacttctgccaggattctcttgatcgcatagtcacggacttctgtctcatgcttgattctttcatccattgttgcaaatgcgatttcaactgcttttgcaattcctacgatacctgtgatattctctgttccagcacgtctttttctttcctgtgctccaccatgaatgaaagaacgaagttttaatccttttctgatatataagaatccgattccctttggtccaccgaatttgtgtccgctgacacttaacatatcgatattatattcatctacattgatcggaatctgagcatatgcctgaactgcatctgtatggaataagattccatgttcttttgcgatagctccgatttctttaattggctggatcgttccgatctcgttgtttgcaaacatcacagaaatcaggatcgtgtctggtctgatcgctgcttttaagtcatctaattttaagattccgttctcatcaacgtcaatatatgtgatctcaaatccttttttctcaagatattcacatgtatgaaggattgcatgatgttcgatcttacttgtgatgatatgctttcctttgtttgcataagcttctgctgtacattttaatgcccagttatcagattcagaaccacctgctgtgaagtagatattctctgctgttgttccaagtgatcttgcgatcgtttctcttgattcgtctacaactttacggttatttaatgctggtgtatatacactggatggattccagaagttttctgtaaaataaggaagcattgcatctacaacttccggtcttgttgctgtagtagcagcatgatctaagtaaattattttcttttccatgattatgattcctacctttcttcttgatcatatttggtatgtatttcgattgattcttccatcaattcttgtaaagtgatcgaatcaaccgcctgctgaacgctgtcattgattcgtttccaaactgtcttggtcacgcagaattttgtgccgctgcaagtcgacgtgtctccggtaaatgctgcacagtcgattggtgttaaatctccttccaaagtccttaaaatatctcctgccgaaatatcttttggatctttatctaacatatatccaccctgtgctccacgaatacttttgatgatccccgccttcttcagtttgggtaataattgctctaagtatctgactgaaatattctgtctctctgcgatcgcactgatcggtaccgggctgtcctgactgtatactgcaatgtctaccatcgctcttaatccatagcgtccttttgtcgataatttcattctctcacctcaatcccgactatataactcggatttcatttgttatcttaacaaagcatgtatcttatgtcaacattatttgtcatatcttttttttttatttcatacaatgattaaaaatggctggtatttcctatgaaaaaggcaagcccgtttatttgcggaactgtgatcttaacactctctaattttctttcaagactcatcggcttctataatagaatatttctggcaggcgtgatcggtgcacatcagattggaatttatcaattgatctttcctgtttatctccttgggtttgctgtctgttttcagggatttcagatcgcactttctaagatcactgctgagaaaaaagctacgggaaatattaatgctgctcgttatgtacttcgcattacgatcattcttacactgtgtctttgtatcattttctccttctttgtattttggtatgcagaactgatctgttcagtttttcttcatgaaccaagctgtgtaccatgcctgagacttgctgttcttgttcttccatttgtcgggatcaaaaactgtattcatggatactgccttggaattgagaattcgggtgttcctgctttttctttgtgtctggaacagatttcaagggtatcctctatctttttactttctgtattcatgatagagaaaatgccagttcctgcttttctagctgtctgtggaatgactgttggggagatcgtttcatttttctttactctgatcttctatttcttacacaaaaagtctgctgacagcttgtcaaagtctactctttctgcatcaaaactttctgtatttcatgaactgttatcccttgggattccactgactttgaatagtttttctgtcaccttattacagagtgtgcaaagtattctgatcccaatgatgttatatcgtttttatggaaatcgttaccgcagcgtcgagatctatggcatcttaagcggcatggcactgccttttatcatgtttccttctacgatcaccaatgcattatctttgatgcttctgcctaagatttctgctgccaaaactcacaacgatccctcttatcttcgacgttgtgcgatcttacctcttatcttttgtacatttcttggaattggagcttttggcggattctttgtttttggaccctggattggaaatttcttttttcatgatcctctttgcggaaagtatttaagatcattgtcttttttatgtccgtttttgtattgttcttccatcttatctaccatattaaatgggcttggaaaaacaaaagatacactgcttcataatagtgtatctcttgtgatccagatttgttttattttatttgcgattcctttgtatggagtgaacggatatttgtggggactgtttcttagttgtttgtttctttgcttcgtaaattatcgaaaagtaatgctgcatgtatgagtcagaaaatagctgttaccgaattcccaaaaatgtctcatacagatccacttgaccatacccccattctctgtttggatagattctttccggatctctccttgctccccggatcagataatttttaattcttgtcgtattgatctgcatatcatttttctgcatgatcccccattctaacatcaatgctgctatacccgcggtaattgctcctgaaacgcttgttcctgattttctgccatagcgtttccttggtaacggtcctagaatttctactcctggtgctgtaaaatctggtttaaccgcatttcttggaaatcccctgctgctgtcgatcgcgaggcttcctgtgttggaattataacttccacaagatatcagcaatcctgtatttgatggtgctaccagtgtattatatggtgtggattccaagaaaaatgtatcttcgctgataaagtttgtgattggaagccacagatcaaattctcgatttcctacgccatcgtcactgacgtagatgttccagattcctggtgccggattttgaaatctcataacgataactggagctcctgcagatgtatctaccgtaaagtattctacgatcagccttgttttttctaataaaaatgttacgtatctttgcccgcttaacccaccttgtatcctacctgttttctgtcctgacggtgactcaatatctacataatagcggttcggagctaatccccataattccattgtaaatccatactccgactctccaactttgacttccacttttgcatcattttgtgaaacctgaccactgtaatgatgtcttgcctgcccctcatttccagcgcttgtgacaactgcgactccccgaagcatcgctctgcctgatagatactggtctaatggtcctgttccaagatgagacgcaaggttggtgccaatgcctaagaatatgacgatcggtctttgcaactgttctgcaatatgatcgatatagtgaactgccagcatgatgtctgtttctgcatatgcttcgtattttggatcaatacagtaatattctttcaaatagtcttttgcttttcttaatttcactacgatcaatcctgcattcggagcaattcctgaaaatcctgtttcgttatcctcatttccagcaattaaacctgctaaaaaagtaccatgtccggattcatccttcgatggtactttctgctgtggcacgtcgctttttagtgcctcttctatttgttcttttgtatattctgtcccatatcccagaaatgtatcttctgggtcaccttctattgtctgatcccagagagaatatatcttactgctgccatcttcatagcgaaatgctggatgttcatagtcgatccctgtatcgatcattccaactaaaacaccatttccataaagatccaaggtactccttctgacttgcgctactccgacatcttctaacatctgtgtgtccatcagaccgaaacaacgtggaatcgtattatatggataattttgtccatatatggatgtccgtccgttctttttgacatatgcgatcgcgaatctctgatcgatcactgtaatacattctgtgttgaattcttcttttacatagtcaagtactccgctgtattccccgataaattcaaaataatcattactctgggctgcattttcacatagcatagaaatacctcaggttttttatagtttatgcacccaatttccatctgttaatctatgtgtatgatacaatttatgaaaattaatttaaatacgctccgtaataagtcccttctgataagcccataataactgttcgagatctgccactttctcctgcagtgccttgccattatcagtatccataacacatttacgtttcgttaccttattgataatgatcgtatctgaatggatatctgtttcctctctgatcgctgtagttcttgatacaaatggttcgtgtgctacgagttttaatccgtaagaattagacactaaggtataacctgcgatccctgttgtcttctgataggctttcgagaatccaccatcaatgacaaatagctttcctccacatttgatcgggctttcgcctttctttactgctactggcatatgcccgtttacaatcttgcctgtcgatgtatctaatccgaattcttctaagatctggttgatcactgcttcattttcataccactgatagtaatagtctttcttttctttcttaagatctgcatcgtccaagaaatagcgctcaaacgttgccatctttgcttttccgtagactggtgagttttcatttgaccagatgaaccacatgatgtcttgtccatattttctggatttcatatctttttcttcataataaccctgtcttgctagatgttctaaaacatcataaagttctttccctgcgtactttcttccttcaatctctacttcacgaaatgttccatcttcgtttagcggtacacagccatgatatagaagcattccattgaacaccttgtataagtgtccttttgcaaataagaatcttatatgttcctgaagataagcacagtatttaaatacagttaccagatgttccatcacatattcttcttctttggtcaatttatatggatcatttggatcgatcgttggaaaattcttatcttttaattcatattcttttccatctaatgtgatcgttcctttttcatagtcgatcttgtctaatagtaatctttgatccatcaaaaagtctggacggcgtttgatcaattgaccttctactttaaactgcatgatcgcaatggctttgtgcatcttcttattcaattcttcttctcggatattactctcatccacttctccagatgcatggaataattcacattcatcatctttgtaacactccaatgcaaatcttgccagcgggatcagattgatgccataaccattttccaaaacatccagattattgtatcttgcacagattcttacaacattacaaatacatgcgcggtgcccagatgcagctcccatccataaaatatcgtgatttccccactgaatatcaacattcgctgtcttcatgatgcagtccatgatcctgtgtggaccagatcctctatcgtaaatatctccgatcacatgcagatgatcgatcgtcagatcctggatcagatgggccatcgctgcaataaactgtctgacccttcctgtcatgatgatcgtctcaagaatctgctctacatagcgtttcttatcagctctccggtgttctaccatcaattcttccatcacataggcaaattctggtgacattgctttccttacttttgatcttgtatatttattcccgactgatcttgcaacatgaaccagacgtaccatcgtatcatgctgccattcaagaaggaaattctttggtaattcttcctccattaaatccatcttctgctccggataataaataactgatgccagatttttcttttgctttgttgtcagtgtattcccaaattcatcttcaatcctgcttcggatcgctcctgatccattccttatgatatggctgaatttctcatattcgccgtgaacatcagaaacataatgctctgttcctttgggaagatgcaagattgcctgaagattgatgatctctgttgaagcagctgcgacatttggataacgcactgccagttcctttagatacttcatctggtccatgagaagtctcccctttcgtttacgcttttttgattgttctgtaatattatagcattatttttcatactttcccaataactttctttcatttttcttaattattatacttttatgaaaacaaggctgttccttatgttatactgtaaacagcctaggtaaaatctatgtaaatttccatatttactgtccttgatcttcacaggctacttacaataaggaggagattatgttaaaaaagaacaaaagcattgcactggtgatgatcttagctttattgatcatcacatcttcttgtgcaccaaaaaacacacaggcagaaattgataaaccagccaaaacaagtgcctcttgggagaggaaactttgcagatcaaaacttgatatcatcagttcttacggtgatgatcaggcatttcacccaaaagtcttaaactttgaaaaaccatggaacggctatcgctattggatggcatacactccatatccaggtgcagatcagcgaaaagaaaatccacacgtctgtgtctccaatgacaggattcattggaagccatttgaaggagagggaaaagctgtttcacttgatccattgaccccatttgaagaccctgacaaacagtataattcagatacccatcttgtatatagaaaagacatcgataccttagaatgttactggcgccaagtcgataatcgtaccaggatcgataagatcatgaaacgtacaacaaccgatggtatccactggagtaaagctcagaatgtattggtttccgatgcacgcactgatcgtattctaagtccggcgatcatttatgaaaacggacgatataagatgtggactgtcaactgtaaaagtaaattccctgttttataccgtgaaagtaaagatggttttcattggacaactccaagcacgattcagttaaaatatccatctgacagacttcgaagctggcatctggatgtcattcatacagaaaaaggctatgaaatgctcgtcgttgccttctacaaagggcataggcaccgggaaatgaatctttattatacttcatccaaaaatgagcatgattttaagaaatgtattacgatcttaaaaccatctgaaaaggaaaaagcatgggacaaccgtggtatttaccgtagcagcttttttgtggaaaatggaatttattatatttattacagtggtattggatatccaaaagggccaaacagctctcagggtgttggactcacatatggtccatcggtgaaaaacattcatggttacgatgcataaaatctcttgacgttataaatattcaggtgtaaactgttagcaataagaatttttagccgaccatccaaagactggctaacgactctacaatacgaataaaaggaagtgcattaatattatggaaaagaaaaatatcgactgggctaacatcggtttcggttatatgccaacagattaccgttttgtagctaattacaaagatggagcatgggatgaaggtgaattaacaacagatgccaacatcacaatctctgaatgtgccggtgtattacagtacgctcagacatgttttgaaggaatgaaagcttacacaacagaagatggacatatcgttgtattccgtcctgacttaaatgcaagccgtatggcagattcatgcagaagacttgagatgcctgtattccctgaagataaatttgtagaagcgatcgagaaagtcgttgcagcgaatgaagcattcgtaccacctttcggttctggtgctacattatatatccgtccttatatgttcggaagtgatcctgtgatcggtgtaaaaccagcaaatgaatatcagttccgtatctttactacaccagtaggaccatacttcaaagaaggagctaaacctattactatccgcgtcagtgattatgatcgtgctgctcctcgtggaacaggtaatatcaaagccggattaaactatgctatgagcctttacccaatcatggaagctcatcgtcagggatttgatgagaatatgtatcttgacccagcaacaagaacaaaagtagaagaaacaggtggagctaacttcatctttattacaaaagatggtaaagttgtaacacctaaatctgacagtatccttccatctatcactcgtcgttctttagtttatgtagccaaagaataccttggacttgaagtcgaagaacgtgaagtattatttgatgaagtcaaagatttcgctgaatgtggattatgtggaacagccgcagttatctctccagtaggaaagatttatgatcacggtaatgaaatctgcttcccaagcggaatggaaaagatgggacctgtcatccagaaattatacgatactttaacaggaatccagatgggtcatattgaagcccctgaaggatggatcaaggttattaaataagactttcgttaatagaatattaaataacataaaatgcagccagacagttatcgatttaactttctggctgcatttcatttatacatattggcgtatcattcttatttactgatctcttagatgaatctctggatttccatgattctcaatataatctcttgtgatcgttacgcttccgatcgtgtcgtcttttggtatctcgtacataatgtcgagcatgaatttctcgatgatcgcacgtaatgctctggctcctgttttctttttcagagcttgttctgcgatagcctccagagccccttcatcaaattctaattttacttcatctaattctaataacttctgatactgttttaagatcgcattctttggttcttttagaatcttgactaacatctcttttgtcagtccttctaatgtaaatatcattggaagtcttccgatgaattccggtatgaatccatattctctcaaatcttcattcgtaacctgtgcaatgatgttttcttcttcatcaaaacggtcttttaaatctgctccaaatccgatcgatgttttcttcatcagacgttttttgatgattccttctaagttcgggaaggctccaccacagataaaaagaatattccttgtattgatcgttgtgagtggtaccattgcattcttgcttgtagctccgactggcacttcgacttctgctccttctaagagttttagcaatccttgctgaacggattctccactgacatctctgctgtttgtattttgtttcttggcaatcttatcaatctcgtcaatgaatacgattccatgttctgcacggtctacatcgttatctgccgcctgtaagagctttgataaaacactttctacgtcatcaccaatatatcctgcttctgttaaggatgtagcatctgtgatcgctagtggtacttttaacagtcttgcaagtgtcttgaccagatatgttttaccacttcctgttggcccgatcatcagcatattcgatttatcgatttcgatctcatccattgtgtttgtaaccactcgtttataatgattgtatacagcaacagacataactttcttcgcataatcctgtccaataacatattcatccagcattgccttgatctgatgtggtgctggaatatcttttaatgtaaactctggctcttcttttttgtctttctttttcttctttacttccgcttttggctgcatactctgcatatcgttcatcatctttgtgatatccatgctgtcaagatccatatttcttgcgtcaataaatccaaactgaccattgcccatagaatttaatgtcctctgcatacaatctgtacatataaaaatattattcggaagttctaacatcttaccggctgcagattccggacgtctgcaaagatagcagtaatgttccacatctttgtgttcatcctcatttgttacttcctcaatctcattttgatttttctcttctgacatatgattgtcctccactttttattttgaatagagtacttctcctataatttcaatccctcttatcatatcttcttttttcattctcgtaaaccccaaaatatattcttctttcaatggttttccttctatataataccatgagagcggatagatcatcacgcctttttgtcttaattttttttgaaactctttttgatcactgacagggaatcttacgatgatatgtgctcctgctccatgaccatatatttgaatatcggagtttaacttcttaatttctttgatcaatagatcatgtttctctttataaatattcctcatacggtttaaatgtcgttcaaaatgcccttctgtcagaaacagcgtcaaaactttctgatcgatccttgatactgcacaggaaaatgtctggccaatctgctgatatctctttgcaagtttctttgggagcaccatataacttgctcggattgctggtgcgatcgcttttgaaaatgttcccatgtagatcacattttctccatcatctaatccctgcatcgctggaattggttttccatgatatctgaactcgctgtcataatcatcttcgataatataatgatctggatcttttttagcccatcctaataattgacttcttcgccctattggcatgatcacgcctgtgggatattggtgtgccggggttacatatgctaagttcgcatctgttttctgcaattgttctacacacattccactttcgtccatggagatcggatgaatcttaaaatccaattcctttaagatttcatacgcatttttgtaaactggattttcaattccaatggaaactttttctcctaaaatctgacgtagtaaaaatagcagattctccattcctgctgccactacgatttggctggcatgaacatgaacacctctggattgtctcagataatacatgattgctttgcgcaattccaaatctccttgaaaattccccttttgaaataactcactgttatcattgatcatgatctcttttagtagttttctccagatatgataaggaaactgttccatatcaactcctgctgatgaaaagtcgtatggtatcttctctggtcgtatttcttcttcctcttcttcgatcttaactggaatgtgaagctctgccagttcttctacctgacagacaaagaaaccacgttttggttttgattcaatatatccttctgcacaaagctgtgcatatgcagtgtccacagtattcctgctgacatctaaatgtttggaaagtctccttgcagaagggagtctggccccaaagggcaaaactcctgttataatttcttctttgatagaattataaatctgctcatataacggctctttttttgaagtatcaagtgcaacgatcagcatataaccacctgttttcctctaatttattctgcatttgaaacagtcattttctctattacaactttcttcactggctggcttacttctccacttccattatcttgtgtcttgcatcctgaaatcttatctaacacatcatatccattgatcatttgtccaaacacagtatagcttcctgttaaggatggatatccaccctgatccaagaataacgcttgttgtttctttgtgagctctacattcccttcttccagacctttcttcgctgtatctgctttcgcctgcacgataaaaaactgacttccattcgtatctgctccggaatttgccatacataaagaaccgcgaagaggcagaagttcctcacatacttcattatcaaagtcttctccccaaatactttctccgcctgttcctgttcctgttggatctccactctggatcataaaatcattgatgactctgtgaaagatctgtccatcaaagtatccattcgatgcaagagttacaaaattcttcacggctaaaggcgctttcttcatgaagaacttaaactgcatttctccataacctttgactttcatagtgacgatcgtttctcccttttgtgcatccgcaagttggtctgttttctttgctgctgtgatctttggtactttatattttgattgcactttcatctttgtttctgttgttgcttttgttgtatctttgctgccgtcttttgcagatgaacacccaacacaaagtgtcatggctgccatcagacatcctgctgctatgatctttctcatgtttgctttcctttctgttttaagagattgttcacttgcgatcactgttcccggatcttatctgccggaaatacaattcctgtctgtcttcgcacttcatccgtgatatccatctcgatctcggatgctcttaaaaattgatgatccactttatgttctttgatcaatctgataaaatcttttgtttcatagatcatcggattatctcttttgtcaaattgtaattcttctatttctccatttctatagtaaatcgtgatcttcttgatgatcggacattgttcaatgatcatacatccattttcaccctgaatctgtgttggcagtttggaatctgtaatcttggaatatatgatctccgcctgtttatcgccatacgatgcgatcacacttcctgcaccatccactccattttcaaggaacaaactgtctgcgagaatcttttctggtttcccaaataaacttgcaaggaaatggatacagtaagatccaatatccatcagtgctccattcgataatttgggattaaatgcgttttctatgatcccttttttaaatttgtcatatcttgaagaatactgacaatactgaatcgttgctcttctcactgttccaatcttatgaagattgtccatcatcgcatggaatcctggagaatgtacattcttcatggcttccataaatacaactccttgttctttggctgctttgatcaggatatctaattcctcacggttggagcaaacaggtttctcacaaagcacatgctttccgtaattgatcattgtgatcgaatgtgcataatgcatataagttggactcgctacataaaccgcatcaatctctggatcttttgccatctcttcgtagttatcatatactttttctacattatattttgctgcaaactgcttccctttttctaaatttcttgaatatacagctgttaattggatttcatctaattctaaaattccttccatcagccagtctgtaataaaattggttcctatcgttgctaatctgatcattgattctcctccatcatatatcttatattttataattgtgacagtgtaatgtcaatgatcacgcctaccgcataataatatacacactatagcaaagatacatgcagatcattgcaattccttcggttcttgaaatcttttttttcgttgctccaaagatccatactacaactgaaaatacgactaaaactatgatgtcgatcacattttcaccaattagctgtaatggactgatcgcagatgcgattccaagtaccataaggatgttaaagatattggaaccgatcgcattcccgaccgccatatcaacttcattttttcttgcggctacgatggatgtgaccagttctggaagagacgttccgatcgaaacaatcgttaatcctacaagattctggctcattccaaaatctatggcaatcctgcttgcagcatcaactgtaagatctccaccaaatgcgatggctgctgcacctccaacgatacataacagactcattggataagacatgatcgtcaattcttcattttccattgtttcaagttgtacgacttcctgattatttctggcacgcattgcctgaaaaaccatcataagaacatatacggcaaatataataaggaaaatgattccatcaaaacgtccaaggatcatatgtgatctatctccgaatgcaagataaccaaatatgagaagtaatgtcgcacatacaagagataatggaatatctcttataattgtttctctttttacaccgatcgttgctaaaattgaacagactccgatcacaaacatcatattaaagatattagaaccaactacattactgatcgccagagcattattattggcaatagacgctgttacactgactgcagtttctggaagtgatgttcccatggctacgatcgtcaatccaatgataatagaaggaacttttaaacgtttggcgacacttgaacttccttctacaaaatagtctgctcctttcattaaaaatgcaaatcctatgatcagacagatgatcactaaaaataatggggattggttgataaatttctccatttgtttttctcctttcaaaattgtctttttatttgtacataagaaaaactcatgtatgttccagatgtactataagaacatacatgagtctcattctttaatatttgccaggctgacttgcttgatatctgcgagtcattaccgagtctgttgacaaatcacgtctttgtataacgcgaactactccctcatggaatattgattgtttgattactttaacaaaaaaatattgatctgtcaagtatagtttattttgatatacaatgcgatcaacaaatggaggggggaaactatttttgatcagaaaaccatacaaaactaataaaaatatttccagactattttatattttgatgatgatcatctttgtctggttcattgggattcagattttaggacctgatgaacagttttttgaccaatctggacattccatcatctacaatggtacttttacatggaagaaatccgatggcacaaaacaaaacatttctgttcctggacgttataaagttccagcaaaacagacgatgatcattactactacacttccagatgattataacgagaatgtaatcgcgatccgttcttcccttcaagatgtacgtttttacattgatggaaaacttcgaaaagagtacaatgcaaaaagtctgcaccgatttggcaaaaactctgccagccgttatatattctgcaatacttcgtctgcagatgccggaaaggaacttcgtctggaacttacaacatatacgagtaactactctggtgttgtcaatacgatttactgtggagatcaaatgcagatctggagttatatttttaatcataacttctctgtaaccgtgatcggatcatttatcttttttgcatcgattgtcacaatcttatttagtatcgcccttggaattgtttacaaaaccaagtttaatatggaatatcttggatggtgtatgcttatgggatctgtctggatgatcggagaatcaaaaatgcgacagcttcttgttccaaatgcatctggacttgcaacttcatgttttattatgctcatgttatgtccgttaccgatttccttatatgtcaataatcttcagaaaggtaaatataaaaagatctttcaatcgatctgttttattgctttattgaattttatcatctgtacgatcctgcatcttacaggtattgcagattatattgagacaatgccagcagcacacgcaatccttattattacttttcttgctgtcattattactttcctgatcggatattggaatcatcggagtcgaagtgattgcctgttgttctttggactgcttattacaatgctttctgtgatttttgaagcaatttctgtatattacaaagtatctgtttctggcgtatttgtcggtatcgctattttgatcttgttgtttatgaatgtaatctatacgattcatatcatccgtgatatcatcaaacaccagcagcaggaagaactcgataaacgtaaaaaaaatatagaggagatgtctctgcagttgatgcagatgttgtccaccacgatcgaggcaaaagatgaatatacgaaaggacattctcatcgtgttgcagagtattccgttttgatcgcacgtgaacttggatggaatgaaaaagaacttagtaatctaaaaaatgctgctcatcttcatgatatcggcaaaattgctattcctgataccattttaaataaaccaagcaaactttctgaggaagaattttctattattaaggaacatacgatcattggtgcaaatatcttaaagaatatttctctgatcgatcacgtacaagaaattgtacgcaatcatcatgagcacgatccgtacacaaaaagccaaagaaaatctcgactttttaactgggcttccaaacagaaataaaggtgagcaagccattgcgcagttgatgaaacaccacagcggatgtcttgtctttatggatatggacaatttaaaaaccatcaatgacatctatggccacaaagctggtgaccgtgtattgaagcttcttggtaatttattattagaatattccagtgaatgtcttgtctgtcgtcttggcggagatgaattcctattatttatgccagatgctgatcaaaatagtattacagaagttataactgctatttttaagaaatttaatactcgaaaggaacaagatcctgagcttcatgctgcatccatttctgccggactatatatgtgcaatattggagattcttttgacgaatgttatacaaaagctgataaagcactatatttcgtaaaacaaaatggaaaaagcgacttctcctttcatgaaaaataaagcaccaaacatataaagaagagagtggcaagaatttacttttgccactctcttctttatatatgaaataactgaatcaacacaagaccagaaagtccataatatgtgataactgcaactaaatcattgatagttgtgatcaatggaccagaagccactgctgggtcaatgttgatcttatgaaagaacattggaatgatcgttcctacaaggcttgagatcaccatcgcaacgatcagtgaaattcctacgcaccctgaaatcaggaatgaagaaatccatgcataatgtttaaataaatggatgtacacccctaaaaatacgagtgccatgatcgctaggctcgctccatttaagaaaccgatcttcatttctttaaataacaaagcaatctttttcttacctgacagattttcatccattaatacgcggattgttacagctaaagactgtgttccaacatttcccgccatatcaagtaccagggattggaaacagataacaattggtaataccgcaacaatagattcaaacattccaacaactgaggatactgccattcctaagaataacaatgcgatcaaccatggaagtctcttcttcatactaactatcgtgggttcatttaaatcttcctcttctgttaaaccagcaagttttgcatagtcatctcccatctcgtcatcgaccaattctacaatatcggaagatgttaagattcctgcgattttcttatcttgtgtcagtactgggatggaatcttcttcgtaatctgttaagatttccatacattcactgattttttcatgttcatatacataaggataagaactgcttatgatgtcctgtagattatcatgttctcttgcgatgatcaaatctttcagatcgatcgctcctgcaaaaatcccattctcatctatcacataaagtgtctggatattatcatgttctcctgcctgctttacaagtgtactcattgcctcacgaatcgttacatcatttcttactacgatataattattcgtcatacaactaccgatctgatcttcctcgtaagacagcagtttctgaacatcttcttttgcttctttatccagtctctttaataatttgtatttatcttcttcatttaattcttcaaacagatccatcgcatcatctgaatccatgtttgatacaactttcgctgcctgttcaattggcatttcttccagatattttcctggttcctcttcgatataagaaaaaatctctgcaatctctgcaatctctaaaatgtcatagatacattttctaactgttttatctgattctacgatcgcatttgcaatatctctttcgtgataagctgcgatctttttctttaattcttctctatctttcgtcgtctgtacgatcttgaccaattcttttgcataatctgttctatgctgatttcttgcatttttcatgatatcctccttcttttcctaaatctggttgcaaaacaccaatatttaggcacaaaaatacaccgcttcagattgaaattcctaaagcagatcacatactctgttgtgatgtaaagaactttctgtttcgcggtgtatcaaaaaggatatcataatacaaatgttgctattcatgtatcttcacagagagcagcattcgcatcttatattttcttttttgaccccgcatacaacttcgtcctatacgatcgcaactatccatgaacatacacctcctttcacatctttactaatatctctcaacattctttgttttcattctgggttatattatcagatttttctgatatcgtcaacctattttactatgatttaacaatcttttccgccgccgcagtgtgatcctgcccggagggctttttattgcataggggatttcatcgaaatttcctatgcaataaaaaaagcatccttatctctaagaatgctctgaatttcattattaaatctatatataaaggatataccttcaaaacaacatacaagaatctttctacatctcttacacttcagccttctttggttaaagcctcgaccgattagtaacagtcagctccatacgttaccgtacttccacctctgccctatctacctcgtcgtcttcaaggggtcttactaccttatggtatgggaaatcttatctttaggggggcttcacgcttagatgccttcagcgtttatcccttccagacttggctactctgctatgcacttggcagtacaacagatacaccagcggtccgtccatcccggtcctctcgtactaaggacagctcctatcaaatttcctccgcctgcgccggatagggaccgaactgtctcacgacgttctgaacccagctcgcgtaccgctttaatgggcgaacagcccaacccttggaacctgctacagctccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcacagtcaagctcccttctgcctttgcactcttcgaatggtttccaaccattctgagggaacctttgagcgcctccgataccctttcggaggcgaccgccccagtcaaactccccgcctgacattgtcccctgaccggcttacggccacaggttagaaatccaacatggtaagggtggtatcccaacagcgactccggtacaactgacgtcataccttctcagtctcccacctatcctgtacataccatgccgaatcccagtatcaaactggagtaaagctccatggggtctttccgtcctggcgcaggtaaccagcatcttcactggtatttcaatttcaccgggtgtatcgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacttcaccttgcggttttgcatagacctgtgtttttgctaaacagttgcttgggccatttctctgcggccactctcatggcactccttctcccgaagttacggagtcattttgccgagttccttaacaatacttctcccgtcggccttaggattctctcctcatccacctgtgtcggtttgcggtacgggcacatataaaacgatagcggcttttcttgacagccaggggcctggacttccctacttatgttcggtacgcgtcacgtcttcagatcgtgctgcggatttgccaacagcactcctacctcgcttgcaccgggatttccattcccggattccattccctgtctgtgtccccacagttctgtttatatgcggtacaggaatttcaacctgttatccatcgactacgtctttcgacctcgccttaggtcccgacttacccagagcagatcagctttactctggaaaccttagatattcggcctgaaggattctcaccttcatctcgctactcattccggcattctctcttcctggcagtccaccactccttacggtatggcttcatcccgccagcaatgctcctctaccaatgtttacacattcctaagcttcggtgtcgtgtttcagccccggacattttcggcgcagggactctcgactagtgagctattacgcactctttcaatgaatggctgcttctaagccaacgtcctagttgtcttagaatccccacatccttttccacttaacacgtactttgggaccttagctgtaggtctgggctctttcccttttgaccatccaacttatctcgtatggtctgactcccatgaatcatcttgatggcattcggagtttgatatgctttggtaagctttgacgccccctaggcaattcagtgctctacctccataagactctcatgaggctagccctaaagctatttcgaggagaaccagctatctccgggttcgattggaatttctccgctatccacacctcatccccacccttttcaacggatgtgggttcggtcctccacttcctcttacggaagcttcaacctggacatggataggtcacccggtttcgggtctgcactcactgacttgacgcgctattaacgcttgctttcacttcggctccagaccttaagtccttaacctcgccagtacgcacaactcgccggaccgttctacaaaaagtacgcagtccctcatataaagaggtcccacagcttgtagacacagggtttcaggttctctttcactcccctcccggggtacttttcacctttccttcacagtactatgcgctatcggtcactaagaagtatttagccttacggggtggtccccgctcgttcagacaaggtttctcgtgtctcgtcctactctggatcctgccaggcgacttgggatttcggatacgaggctttcactctctccggccggacttcccagtccgttctcctatcttacgtctgccacaacgcagtccgaaccccgcaatgcacgcatcacggtttgggctctttccatttcgctcgccgctactttggaaatcgataaattttctttctcttcctccgggtacttagatgtttcagttccccgggttccccacgtacagctatgtattcactgcacgctgacagaggtttcctctgccgggtttccccattcagatatctccggatcattggatatgtgctcctccccgaagcttttcgcagcttatcacgtctttcatcggctcttagtgccaaggcatccaccctgcgcccttactactttaaccgtagcaggaacgatcgaatctcttgattctctgtttcctcactgatgtatagcgttacatcagcgggctttgtgtttctttcattttcctatctcgttattaacgatgaaatttgaatttttttgatgtcttgactcatttccatttctgaaaatgaattctatcttaattcttgtatgaagttttcaaggtacatccgtgtttcagaaacaatatcctgtatctgctacacttctggtcttatcgaccatgccatccaagaatgtttattcttagatcgaatcatcgataagagcaaaactcttttatagatccggcagccacctatcttcccgggccgtctccagccaagtattgtcggccgcgtcagtcttaaccatcgtgttcgggatgggaacgggtgtgaccccgacgcgcatcgccaccggaatattcagttttaagcctttgacagctcaacaataaaacaacctttacttcttcttccttagaaaggaggtgatccagccgcaccttccgatacggctaccttgttacgacttcaccccagttatcggtcccgccttcggcagctccctccttacggttgggtcactgacttcgggcgttactgactcccatggtgtgacgggcggtgtgtacaagacccgggaacgtattcaccgcgacattctgattcgcgattactagcgattccagcttcatgtagtcgagttgcagactacaatccgaactgagacgttatttttgggatttgctcactctcacgaggctgcttccctctgtttacgccattgtagcacgtgtgtagccctggtcataaggggcatgatgatttgacgtcgtccccaccttcctccaggttatccctggcagtctctctagagtgcccacctgaaatgctggctactaaagataggggttgcgctcgttgcgggacttaacccaacatctcacgacacgagctgacgacaaccatgcaccacctgtctctcctgtcccgaaggaaaggtccggttaaggaccggtcagaaggatgtcaagaccgggtaaggttcttcgcgttgcttcgaattaaaccacatgctccaccgcttgtgcgggtccccgtcaattcctttgagtttcattcttgcgaacgtactccccaggtggaatacttactgcgttggctgcggcaccgaagcctctacggccccgacacctagtattcatcgtttacggcgtggactaccagggtatctaatcctgtttgctccccacgctttcgtgcctcagtgtcagtttcagtccagtaagccgccttcgccactgatgttcctcctaatatctacgcatttcaccgctacactaggaattccgcttacctctcctgcactctagtctgacagtttcaaaagcagtcccagagttaagccctgggttttcacttctgacttgccataccacctacgcaccctttacacccagtaattccggataacgcttgccccctacgtattaccgcggctgctggcacgtagttagccggggcttcttagtcaggtaccgtcattttcttccctgctgatagagctttacataccgagatacttcttcactcacgcggcgtcgctgcatcagggtttcccccattgtgcaatattccccactgctgcctcccgtaggagtttgggccgtgtctcagtcccaatgtggccgttcactctctcaagccggctactgatcgtcgccttggtgagccgttacctcaccaaccagctaatcagacgcgggtccatcctgtaccaccggagtttttacccctgcaccatgcggtgctgtggtcttatgcggtattagcagtcatttctgactgttatccccctgtacagggcaggttacccacgcgttactcacccgtccgccactcaatcaccaaatcttcagttccgaagaaaatcaaataaggtgtttcgttcgacttgcatgtgttaagcacgccgccagcgttcatcctgagccaggatcaaactctcatgttcaatgttgatccaagttcaagaagcactagcttctttatccttgttaattactgttctctataaagaacgttcgttgatttttactaaaatcatctgaaaaattcattagaattttcaaggttgtcttattgttcagttgtcaaagatctttcgtgatccgcttcttgtgtgtaagaagctttattattttatcatagttctttttgtttgtcaagaactttttttaatttattttgttgttctgagctcttctgctctgcaacaacttttatataatatcatttctgatctcatctgtcaagaactttttaacttttctttcagatctgatctctattgttctgatcgttctccgtcagcaacttttataggttatcacatctgatcacttatgtcaagaagtttttttcattcttttcagagtcaaaaaccgaatctgatgttatattttcctgccgctctttcagcgacgttgattatcttaccatagctgtatacagtatgtcaacagcttttttatgttttttcgacaattatttttgccatccatatattgtgtttttctttatcaaatctacaatatatggatggcatttttcattttataatagatacgttatatttatggttcccgaaatttaaatacgcactgtatttttccttcatgatatctaaaaatcctgccttctaaaatattttcttcatagaatggtttcattacccagaatctgtcttttcctgattttaaatagaagtttgtcatcagctcatattttttcttttttgcatactgcttcatatcctttgaaaattttgctatctttggataattattttcggatacgccttccttcttcttcaaattttccagatgatttccctttcggtatgttacctcatctttctttaaatcaatgactatactcttaagttctttatcatctttagcattgattgtttgatcttttgaattatatctgcattcattataaattagatatttttctccatctttggatggataaaacattgttgattcttccttataataataattcattccatatggatgcaaatctatgatcttattgatcttatatgtatgattcttcttgttctcattcagcacaagaaagtaattacctgtcacagctgtaattttctgatcagcaacttgtatgatatccaagtcgttcaattcttcctcttttagattctcgtaaaaatcctcgtagctcatcgtctctagtttctctatttttacaacctttgcatcatttgtattcgtcttctgttttggctttgttgtctgatccttctgacatcctgcaagtacgatgatcagaagtaacactgtcatagataaaaatttcttcatagttaactttcctttcctatcttgcctttattgttttaacctaccatattttcattatatcatttctatatttatccatcaactttttttatttttcgttcataaaattctcctataaaacaaaaatgcagttctgcattccctacatacaaaactgcatttcttctataataaaatttattacagatattcttccagctgatcgatcgaactttcatccgttgaccaacttgttgcaaatctcacaaccgtatggttatcatcatacttctcccaaaaaccaaattctacattcttgctcagttctttcatcttctcattctcaaggatgataaactgctgattcgttggagactctaagaaaaatgtatatcctttcttatgaaagacttcttttaatctctcagccattgcaatcgcatgtttgctgatctcaaaatacaaatgatctgtgaatagagtatcaaactggattcccaacaatcttcccttcgctaataatgcccctctttgcttaatctgtgtcacaaaatgtttcggtgtattatgatgtggaaatacgactgcttctccacataatgctcctactttggttcccccaatataaaatacatcacatagttctgcaatttcttctggtctcagattattttctttactttcaattccgtaacctaatctcgccccatcaatgaataatggaatttcatagttcctgcagacatttgagatctctgttagttcctgtttcgaatacaatgttccatattctgtaggaaatgagatataaaccattccaggatataccatatgttcgtgattatcgtctgaataaaaatcttcgatacatttcttaatatcttctgctgctaattttccgtccttttcttctaattcgattactttatgtccactatattcaatcgcacctgcttcatgcacactgacatgtcctgtttttgctgcgatcacgccttcgtaaggagcaagcattgtgctgatgatcacctgatttgtctgtgtgcctccgactaagaaaaagacttctccatctggacattgaaatgcctgtttgatcttttcttttgcctgtgcacaatattggtccgttccatatccactcaagttttccatgtttgtttctagtaatctttgcataattaccgggtgtgcccctgcgatatagtcacttgcaaatgaaatcatattattgtcctccatttttctttctgatatatattttagcacaaattttttgcaacgaaaaactataacattattttctacctcacaagtttcgttcatagttcatttaatcctgttctttcatatattgaaatacctttttatcattctttgattttttataccagccaatacctatcattataattccaacaataatgactgtagttcttatttatgaagatgtgtttggtgatgattttggtgaagaaggtttttatattttccaaaaccatgatcatctgtttgctctgcccacttttatgtgggctatttttcttttggaaagaagccaaaggcgaactttcctataaagtgacaaaaacaccctgcattgctgcaaggtgctaatgattataaactattcttcaatttaataattctttcttcaatttcacggatcactttaataaaatccacatcatcttttcctgtaggctcatctagtccccagttatcatcaaaaggtctgccgataaaaggacatccaacattacatcccattgaaattgcgatgtctacgtctgggatatctgtaattaacttgctgtattgaccatttgtttccatatcaattccatagagttttttcattatacgaacagcatcctgattgatttgtggctttgtttctgtcccggcggaatagctttcaaacacatcagatgctagatgttttccaagtgcctcggcaatctgacttctacaggaattgtgaacacagataaatgctaccttttttcttccatctatcatttcttgaaccatcctcttgtaatattggccacctttacaagcgcaagcataacaggaacttctgttaatacacctactgttgttgcaagtgcagccggactcgttgtaccaaataatgcaatagctacggctacagctaactcaaagaagtttgatgcccctatcattcctgccggtgctgctatgtcatgtgacattccaaatatctttgacgctgaataagcaataaagaaaataagaacagtctgaaccgtgagaggcactgctatcaacactatgtgcaaaggatttgataagataacttctgtttgtgctgcaaatattaaaaccaaagtaagaagcaaaccaactgtagttgcgttatcaaacttatgaacaaaagtgttttcaaaatactctattcctttatttttaactacaactattcttgttaatacaccccaaacaagtggaatcaccacaaacagaatcacactgaaaaacaatgttccgtagggtactgatacatttgatactccaagcaaaaactttacaattggcacaaatgcaatcagtatgattaaatcgtttgttgctacctgtcccacagtataagcaggattcccttttgtaagagtactccatacaaataccattgctgtacatggtgctgctccaagaagcactgctcctgcaagatactgagtagcaagttctggtgcaataaatcctttaaatactgtaaacaagaacaatgatgcaattccatacatggtaaatggttttattagccaatttgtaatccatataatgaaaagcccttttggattctttcccacttgtttaatactctgaaaatccactttaagcatcattggataaatcataatccagataagtattgcaatcggaatagaaatcccagatatttcaagattaccgagtgcattaggtatggccggtaataacttaccaatgattactccgactaccatacatataaatacccagattgtaagatacttttggaaaaaattaatcccttcactctttttctttgccattaaaatcccaactttccaaacagcttaattacttcagcgctctttaatactttccccattgaagcaactgtttcattcacaacaatggcaggcatactcataacaccgtaagccataaccttttccatatctgtgatatattctacttcaattcctaaccctagttcttcaatggcctttttaacattttcatactgatcatgacagcttttacacccagcaccaagcaccttaatgcttgtaaccttattatctccaccacaacagttttctacctgttgaccgccacagcaacatgatgatgcttcataagtagctacttctccattgcaagcacaagctggctctatcttaacttcttcttttttctttcctaatccaaataataacatgatcttttcctcctgttaaataagtaaatattgaaatgcattaaatgcataaccaacaataataattcctacggtacaaattccaatgaacagacctaagagttttggtttgattgcctttttcagcataatcatggatggaagagacagtgtggttactcccatcataaatgacaacacaacgcccaatcttgcacctttagcaagcagtgcttctgcaataggaatacatccaaagatatctgcatacatcggaacccccacaattgtggcaataatgacaccaaatggattaccattaccaagaaatctcactataatatcttctggtatccagttgtgaataaaggctcctattccaacaccaacaagaatatatgggaatacttttttaaatgtttcaacaacctgctcccacgcatatttcattctgtctttaaccgttagttcttccagtggaatatcgttttgctttgcatttcttataaattcttctacctgattttcaaggtgaagtttttcgataagtattccacctgcaactgcaatcacaagaccgagcaacacataaactactgccactttagttccaaagatactcatcaatagcaccagcgacccaatgtctaccattggagatgaaataaggaaactgaatgtaactcctaatggtaatccggcacttgtaaatccaataaaaagaggaatggaagaacaagaacaaaagggagtaaccgttcctagtaatgctgctaagatgtttgcgccaattccatgaaatcttccaagtattcgtttagttctttctggcggaaagaaactctgaatataactaatgataaaaatcagcatacaaagcaagaaaacaattttcatcacatcatagacaaaaaattggatactgcctccaatcttcccggacgtatcaagaccaatagcgtataagaacttaccaatcaatgaactaagccatttcattcctaaaatttgatcttgtatgaatatccaaatcgtactcaaaaattgcatatttaacctcctaatagttttatagttttacatatatcgatgttttaatttaagagaaaggcaatcttacctgattgcctaatgtatatattattcgcacttatcgcaactgcatacaccatctgaatcagtggtttcaagataatgagaaaacatatccttaaaacggtttttcccttcctctgaaattgagtagtgcatccatcgcccatcttttctagaatcgacaagtccacagtcgcaaagcaatttcatatgatgagaaagagttgattgggtaatggataactcttcaagtataacgcaggcacatttttctccatgatgcaaacattccaaaatacgaagtctgttttcatctgccaaggccttaatcatacgaacatcttctttataactcatagtatccactccttcctgcaaaactacacttattctatcatatacattcacacttatcaatatataaaactgtaaattttctataaaagacaaaaacatccagcacacatattataatgagagtatgcataaatcaatcgaccagtgtaactgattttgaatatattcttgtatcttctttgcattttccctacagtatctacgtaatatcctctgcaccagaaatggcgattctcatatttgtattttaaatttgcatggcgttcgaagatcataagtgtacgcaatatcctgtttcatcttcccatacgctacttttcttctatattttagtgcaaaaacaatatgatacttacaattccatttcgtatgtgctaaactgtttatatccatttggataacctcctttgattttatgtggttggcgaaccaacataattatatcactggaggttttttactgtaagcttaagcaatgctgactcaccggcctagccggggtttattcgttcatcaaagttccgtttctcttctgagaaactccactgtgctgaacaggcttaaagcctaacaataaaataggacttggcacatacgtaatgatgtgctaagccctatttcattgaaatccattattttctattaaatattttctttaatatattcaatattaagatcatcaaaattaatgaaaaaatagtactattaactgcaatagaaaatctaatatcaacacttcagattgctctcaatttaataacttattaaaaatttctgttgaattgcaaaactaaattccagtccatttaagtcaaagccagaagttagttttgcaaactatcccccagaaattactattgcaaataaaaaattatgatatattaatgattcaggttaaaaatttcttttaatcatttttttcggttatctatcgtcttcattaaaaatgccctgaacaaaatgttcaaggcataataaaaatatttgagttgtttatatatataaagacaaaatatgcgtattaaacaaattttatctttattatattaatttgtaatcttaacattcatatgtgtccctattttgcttaacagatagtaaatgaataatctatatcttcttctgcactgatacaatattcatcttctacattgctgccccaactgtcaatgcctccaacacctcgaaccgctccataaatacaaagaatcgttcttcttgctggtggcaattcttcatgatgcaatgcattttcaatttcagatgctgtataaggtaagcatgaaaaagcaaatggctcatcttttttctcaatacgaagtgtttgagatgaataatctgtcctgctattatcgagactcgtatgtcttacaatatctacccattctgtatccattctcataccacattcctgtggaacaagatatggtgttaggctcaaatcagaaacttcatagactccttctattgctcctgcttttctatctggataagtttctcctgataatcctttatataaatatttatctgccaacgttggcataacaaacctcataccaaagactgggaattcaggtaatcctttaacaccattataatgcacattcacctgaattttccctgtaatatctaccgtatatgttacaacaaccgttgtagaaggagtattgattgtttcataagtatattgaaccctgatctcatcagctgaaacatctccttcataactattattatctggtgcatatattttttgtacttcaccatccataaaaacctgaacatctttacaatcgataaacatatcggctgaaagccagcttccactcttaatatgaaatttacttcctcgatcattatctgtcaaggctctccaaaaagtaggctttggacagcgatataaccattcatatccattttttactatagattctaatccaccttgtgcataagaaaatatataattaaattctttgccatgtacaccaagtgtataatcaccatatacaactctcaatttgcttttatctgtataagccatagtaatacctcacttcctgcattgctggtttttcttttcgatcagcaaatacgattccatttcctgagaattcgtagtctgatggcctgtcatcaaagtctcctccatagcgtagaacttcttttcctgttacatgatcttttactaaaattgcttgatcaataaaatcccatataaatccaccctgatacatttcaaattcatcaatcagtttaatataagaatcaaatcctcctaaggagtttcccatatcatgcatatactcgcaaagaagatatggcttcttcggatggttactcagatattcccttatctcataaggctttgcatacatacgactttctacatcagatatggtatcctcatactgtcttgtatagaaggagccttcataatgaactagtcttccatcctgtctctccttaaagtaagtattcatagccttaatatcatcacctgcataggattcatttccaagtgaccagaaaagaatagatgtatgattcttaaacgtctcataatttgttctggctctatctactacaacctctctccactgtgaaatggatcctgggatattgactgacggctcaaccgcaccaagcttctgccatgagccatgactctctaagtttgtctccgccatcacatagattccagcatcatcacacatgtaataccacggaatttgatccggataatggcaggttcttactgcattgatgttgtttcttgtcatacagtttatatcagaaaccatatcctccaagccgatgcatcttccggtttttggattccactcatgtctgttaacaccattgataatcagtcgttctccatttaaaagcattaccttgttcttgatttcaattcttctaaatccaattctgtacggaacaacttctatgatttctccatctgcttttaataattcgatgtaagccttgtaaagatatggcgtatgattatcccactttttaatgtctttgatatcgtctgatatgctgccaacaaagtctccatctttatcttctaattcaatatttctttctaagataacctggtcatccacattttttaatataatccgtgcacacacatcctgattttctgtagcagatacacgaatatttgtatttaatgttccgctcacattatcctcattcagcaccggattcaaccacatatcctccacatgtgcttccggaagtgctctaagagatacatttcggaagataccgaagaagcggaagaaatcctgatcctctaagaatgctgcactgcacatcttgtgaatctcaactgcaagcacattatccttttccctgatatatggtgtcagatcaaattctgatggtgtaaagctgtcttctgcatagcctataaattcaccgttcaaccatacatacatcgcctgctccacaccttcaaagaacagtctaactctcttaccacaaagctccttatccaagtcaaattttttaatataagaaccaaccggattatactcagcttcgctgaacattcctgttccatctcctgcactctctatactgtaagcaccccttctgtaggtcttaccttcccaaggatacagggtattgatataacgaatctgatcataaccggcaagctcaatatgacccggaaccataatcttatcaaaatatgatgtatcataatcctctttataaaaatcagccggtctgctcatcgcatttctgctaaaacaaaatttccactgtccatttaatgactgtattaagttgtgtgaattgctgttcaacgcttcataatttgtgaaatagtcatgatcgctatgtgctgcaatctgattcactctgaatatttccggattatcaatccatctgatatctgcgttcattttcatacctcgctttctaattttacatttagccccaaaagtaaatattcactctggaggctatttctttattccatactttcttttaactgttcgtttgcaccttcaatattcatgaatgaaagaatgattgtgataatcaaatcaaacgcaaatggtaaccacaagtacataacattcatcatactgatacagcttgctgactgaacagctacattattaacatatccgcttgcatccagtaaccatcctgaaagtgctacaccaataccaccaccaagctttgtaccaaaagatgtacacgaaaacatagacccatcaattctcttaccagtcttaagatatgtatgctctgaacagtttgcgataactgctccaacatcaccttgccaaggtccttcaccaagagatgttaatacggtaaacactaacataagaggaatgcttcctaaatatccagctacaacaattcccaaacgacagattgtagcaaatacatagctgtacttattaagcttgtacattcctcttgcttttgcaaccaatgtaggtgtgatagcaagtgctataatcaatggaatattaattgcccacgagaatacaccgaagagtttctgattaaaaagcacatacgtcataaagtaagttccaacgctaagcatagctgctcttaactgctgaagaatatatacaacgcaaatcatgacaaaatatttattagatataagtagcttaaatgtttctgccaatgtaagcttactgtcttcttcctcttttccatctctaagctccgcatcagaaagttccttaaccgaaaagcatgacaatgtatttgatatgataccaacgatacagtatatgattgctacaattctccatgctgctgccccaccgccaaatgatgctacaagtccaaatgtgatggactgaatcaaaagattggtaccaaatgagaacataaatctaaatgaacccatttcaacacgctctttcgcattctttgttacaagcgatgtcaatgctgcataagcaatattatttgctgtgtagaatactgcgtttaataatgtgtatgcaataaagaaccatgcatactgtgcagtcttgcccagactggttggaatagcaaatacaccaaacaatgttacagcacatccaaagaatccataaaacatccatggtctggcttttcccatcttgctctttgttctgtcaatcatagaaccaaagaaaatatctgatacaccatcaaataatttcgatacagcaattaatgtaccgacaatacctgcatttaagcctatggtgtctgtcaaataaatcattacaaaagatgtcagaaatgcatatacaacatttcctgcaatatcgcctgatccataacccactttgttataccattttaggtatttcctctcttccatgtaaaaatttctcctttcatttaccataatgttttctcaatttctttatacatagtatatatataattattgtcaaagaccatttcataaattattcaaaacatacacaaaataacactatcaacaaaaaaatgtatatatttttttgttttttattatttttaacatacacttttttgaactttcattgaaattctatcaaatttacataaatatagagatattttttatcatttcaaattaaaatagacagtatagttgtaaaatggtaaaattatatagtaaatataagtgaatttttgcatcgatctttcatattttcgattcattctatatgtaaggagctataatgtatacaaataatgcatatctaaacaattcaaccattgaccgaaaagacaaatccaaacctcttgtcataactatgtgtggaacttataaattatatacacgtcccaaactccccacatggcgacctcgtggtagactagattttcaattactctatattgctgctggaaaagcacattttcattttgataacaatgatgaagcaactattgttcatgctggtcatatggttctatatcgtccaaaagaaccacaaaaatacgaatattacgcaaaagatcaaactgaagtttactgggttcactttactggaaacaatgtcacgaacctgcttcgttcttatggacttactaataaaaaagtttttcactgtggatccggtgcagaatatcaaaatctgttttgttctatgataaaagaattgcaaatgtgccaagatggttatgaagaaatgcttgaaatatatttaaaacagatttttatcagacttcagcgacattttaaatcatctctcaattctgataattcacatgctttcgaagaaatagataacgcaatctcttacttttgtgaacattataatgaaccaattaatattgatgattatgccaaagaaaatcattttagtactagttggtttatccgtaattttaaattatacactgggattacaccaaaacagtatattctaaaaaaaagaatatataatgcagaggcattacttcaaaatacacaatataatatcaatgaaatcgcacagattattggttatgacaatcctctgtattttagccgtgtttttcaaaagacaaaaggaatatcgccttctgaatatcgcaaaaacatatcacaacgtgtattcaattctccttctttataaattatgtataaaaaatagagatactttgtaattaaagtatccctattttttatcatctgtccgatgatttactttcatttataaaactaggatttcttgtatcaattattttctgttcactttcaataagaaaaaagcctttacttccatggctaataataagtctctatttttcaataactattgcaaaattatatcttgtttaagaaaatattttaattttaaagataaaaaattcttcatcctgcaatgctttatattctatattgtaattattcagaatattacttacaatatataaacctaatccattactattttccttatttaaatcaaatttaacatcaaatattttatccatattcgaaattttattgttaccgtatgaattctctatatataaccaatcattaactatcccaatattaattaccccatttacatcagtatattttaccgcattactaatcaaattagatagaataatctttaaagctgtttttcctatataaacattctcatctaatatataattattgacagttattttcttttgatttgctaatatttcatacttttttaatatgtcttctaatgtatcatttattttcaaatattcttcatcattattcaaattttctatagaatgaactgataatatttgagaaatattttttgttaaactatcaacgatttcaatacattcattaatataaatatctctttctttatattttccaatattgtatttcatgttttccagtattattttaagactagcaagaggagttttaagttcatgggatgcacctttaaaaaagtcatattttaacttttctaattttaaaatttctttatttttaaattccaaatcgtcaattgttcttaataaagtagaatacaaatcattaatttgttgttttaattctccaacttcatcattagagctaacttttaaacgcgtttttttatcaagtttcatcattttatcagtaacaatttttatttcttgtatattattttttattgattttgcataaattaaagaaataatagcagaaaataaaattgatattaataaagaatatggtaaaaatttaaggcttaaatctttcgcatctttttgcatatcagctgtagaaacaaattgtagatttgtttttttaccatcattaagctttatttctctttcttcaattatcaaagaattactatcactttctaaactaacatttatattatctttgatttgtattgcattcttattatttttttcttttataaatgcttttatttcactactcttagaataaagctccaaagtttgttctatatattttatttcttttccattcatattgctagaaatttcatttgccatattatgaatcttttcttttctcgtctccaaatatgttttaggaaagataaaaaaaactaatgaatgaactaatataattattattccaagaacagaaaatatttgtatgaacatttttggaaatatctttaattttttcattttctctccaatttatatcctacatttcttatagtagttatacagtctaattgtaatttttttctaagttcttttatatatacatctattactcgatcataaggaatttcttcgctatctttccatacataatcaataatttgcattcttgttaacacttgtccattattatccaataaacattttaatacttctagttcttttgcatttacatctatttcttcaccatttattttagctgtatagctattaaaattaaccgatagatccttatattcaaacttctctaaatgtccataattcttcttaattaaagcatctattctagcctttaagaccggcaatgaaaatggcttttctacatatccgtctactaaattagtaaatgcatcaattttatattcttcatcactaaatgcagtcaagattagaattggtaaattgcttttctttctaatttctttcaacacttctaaaccatttataaaaggtatctgaatgtctaagataaccaaatttatatcgctattaaattttgacaaggcttctcttccatctttagcttgaataacagtatatccaaattctgaaagatattcacttattccctctcttatcatattatcatcttcaacagttaatattttcatatatacctccacttaagcctatacacttatattatacagcatattatttgatatttaaaagcaaaaaaatttttggtgctaaaaagcaccgaaaattttaattattgtcaattaataattcttttggattccttcttaatatattgaatgaagaaataatcaatgatacaagaagtaccaaactcataaatataactacataaattatgaatttaggtaatacatttatatctaaacttgataatgtcttgttaaatccttcagcttctgccccaccacctaattggctagatgcagattgtctagctatttgtttagctatatcaccagtaaccttattcaatatattattcccaagcttatcagctgtatattgagctaagaaataagaaccaacgaatgcggggattgatataaataccatctcaattaggaattgaccaaaaatttctaattttgatatacctaatgatagtaatactgctatttctttctttctagcattcatccataagaataataataatgaaactacaactcctgcaaatattaatgagccaacaaataatttatttgaaattgagtagatacctgatatagattgttgtaatgcagggtaatttgatgaacttttaatcaaattatattctctccaatttatatctaatttcccaagaccttttattacactatcaagattcttatcaccttttacaaagaatgttgcatcttggtatacagctgtatcttctgtattaccataaactttagcagctgtatgaacatcagtgattaatgtattttcgtatagttcttgtgctgcacttactccaccgctattatgcccatcgaatagacctttaatttctacttctactatttcatctgcacctttctcattatcagcatcaaataaattagattttatttttatcttatctccaactttaagattatttttttcagctaaatctttatgcattaagattttatttttatctccattttctaaatgctttccttctactaatttatatgcttctgatacaaattttgtttcttttgatgagtcgttaactccagttaacataactgttcttttaaaattcttcgctctttcaggtgattgattcgcaagagtctcttgagtttcaataatatcataatcaactaaatctgcaacactgtttattctttttacataggagtctatactatctgtttgagatatctttttaatatcttcaccttttacatttcccccacctctaggtgttcctggatttacttgtctatttatctccatagaaaaactatttgttatattagcaaatgtttcttttgaagctctgtccgtagcatctttaatagataaactaatgagacttaaagttgacatagataaaataactaatataataattaatgattttaagctttttctagttacataagcaaatgcattttttatcattattcaacctccaaattcattttatttacttttttcaactttttaccacttagttctaaaatgatatccgcagaatctgctacttccttactatgtgttacaactattacacatttatttctatctttagctaatgtctttaatatattaattatttctccagcagtaacactgtctagattaccagtaggctcatcagctagtattattggagcatctgataccaatgctctagcaatagctactctttgttgctgtccaccagataatttcataacatttctttttatttgttttttatctaaacctagttcaaacaagatactttcatctgctgatttatttactaatctaatattttcaattggtgataaataatctattaaattatagttttgaaatactaaagatatattattttttctatgattactatatcctttcttttttatatcttcattcttaaacaatatttttcctgtttgaggtttatcaagtccagcaagcaaggaaagaagtgtagattttccctatcctgtcaagttatatccaaaaaaaattgtcgatttttgcaattaaaagaaaccattcttatcgcttcttctgtactggaaaaggatttttcctttccaactcctgtccctgcatttccatcttttttataaagatgtgctgctggctgtcagtttcatattgaattgccacaccaagaccttttttcataaatgcagcaactcccatatctacaaaagcctcctgcccttctttctcctgaaaactgattttagggaaagccccggataatttttccctaatatacagttccattttttccaaactctcaaatggcatagcctgtactctttgtaatagctcctgcaaacgttcctctctcataatacatctgcaatgatcaacaccaaataccatagcaaggctgtgtccgcaatcccaagatacatgaatctgtccggcatcatctacaaactgtacggttcctaaatcaccgggactcagttttacatacggatcagcttccatatcttccaactctacccgacaccccggtgggtacatatttcttaacacaattctttccgcattacttatcactgttttcttcctttctccaatccggctaccgtcccaaagacttatctgggacatttccctccaacaaatactctctttctttattccattccagcaccttttccatagcagcttccaactggtcttctgtcgtttctcttgtataggttctatattcctgaaaatagtcttccaaagtgttctgctgtatctccagttcctctttatcataacaatccggctcttccagctccttcaactcctgcaagatttcccagcattccaaaacactgtctatctcccgcatttcaagcagataagataaaaatgtttcctctggcataatactgaaatagcaccggtcaaaccattgctcaatatacatgcgttcatcagaaccattggtatgtgtaccacaaatcaaatctgcaacaaagttttcaaatagttcaccgattgatagcccaacttttccagacttcctacagagctcttctacctcatcttgatacaacctgatagaaatagtccgcttcaggcttttttcatagggttctatatcttcccctgtctcgcagaaatgcagatatgtatccgtataaatgttttccatatcgcaaaatctccggctcattgccacataatctttactttcccggtcccattccagccggtaatgatgttcccttgcatgttcctctaaatctttccgtatgatatttctggttgcttccggcaactccgcaataaaaatgcttgtatctggaactgctaatactctttcttttaccacatttgtcctccttacttgtaactatttcttgcacgcggcaaattccccagtacgtccatatagaggataattccctgcgagtccagatgtacggtaataaatttctgtatttcctgtaacagatcatgatcagaaaacccagcctggcagccaataaaattcctgattttttctacaatatcccgtttacggaactcttgtaacaccagaatcggaatcgtgtgctgacctcccatagcattatatgctagcttttttcatagtctttccgtaaaatatgtttcaagatacatggctcttctccccttccttcttttctaaattttcttctaaataaaagaagaggaaggcaccgcagcgttttcctcttcttttattagtcttttctgactgtataatcgtattataaattacttagcattaccggctgaaaatttttaatatctaacctttttgcaaaatattccatattatctaaatcactttctgagaaatatgaaatataccatttacacgaatgtaatactctctttctaatctcaacaaaataatccatatctacagaagataacgaatgacctaatataaatatttcatttatatttataagagagtcaaaaaaattttgattcatttgtataataccaaacgtatctttatatgtcttttgaaaataggctttaatgatttcttttgtttcagttattctaaaatcttcatcatcatcttgtatatatattccatgttcttccgctgcattaaatggagaaacagctccgtactgaaaagtagaaatatcatgatgtcccactacaagtttcttactgctcagggcttttccatgaatgtataaaatattctcagcaggtactttatatgctctttctaatgtatccgtataattaaaatttagaatcttacacgtattatttattatacgctttgataccaaaggtaaaacgtttgtatctatttgctcaatccatttcttaaaataatatggaatataagatgcaaatgccaaatcctgctcaaccataaattgaaagtcatgattagcactgtctttccaattttcgtcaccataatcaagataatatgaagcattttcttcttgcacttgatatttatctaattcgcctaaagccatttcaaattgaaaccacaattcttcttctggtatatatttacatatagcttcataaaattcacgagcatatattctcaaatactccttaaaatcataatacgaagtgggcaaattgtgtgcccgatcaaaaccatttcctataataaccaatctgtccaatttcttttctctcctagtaaatatgttccaaaaatgtttgcactgctacacaagcagctgttagacttccgataaaagctgttaaagatactattaacgaagaagccatttctagcagatgtacaattctggaaacattttgatttgtactattaggaaacagtaatctccttaccttctgtattaaaaaataaaatgttttaatgaacgagataagtatataacacaaataggaacacacgattatgccccctatgcaaaatcctatatctcccaagtgagatccttttttccaattaacaagaatataatgtatctcccaagaaaatataattaaaacagaaaatgcagtaatggcatggatgcttactgtaactatctttttctctttagtttctctcgataaagcaggaaaactaataaaccaaaatgcaatacatgttgctcctattgataaacgtgtttcatttgctccaccactatataaggctggatatgcaccaatcgttaacattaaacatcccattaacaacaaacccatattaagactaagtgctattttccttttattttcacgtatcaatgtacccattttaaacatctccattcgtattctatttctaagttaaattattaacctatcatattttctttggtttttatattacttttaatgcttatttttctttatattttattgtaccactttttcaataatcttcctatatcttattttcataatgatgtcgagaaccgccaatactctttcttttaccacatttgtcctccctgtttgtaaacattccttgccgccggctggtttcccaatacgtccatatagaggataattccctgcgggtccagatgtacggtcataaatttctgtatttcctgtaacagagcatgatcggaaaatccagcctgacaaccaataaaatccctgattttttctacaatgtccggtttacggaactcctgtaacaccaaaatcggaattgtgtactgccctcccatagcatcatagggcaacgatttccgtaattcttctaagagatgccggtaataatcaactaccacctggtctgttttccacgctttttcctcacaatcccggagtaaaaaatcatactctttttttgcctgttccatttctttcaggatttctactgcctccacagagcaataccctttctcttctatcagctccatcagttcttccatagaatatgtttcaagatacatggctcctcccccatcttctttgcctaattttctcctaatacaaagaagaggaagacaccgcagcgttttcctcctcttttatgaaatctttttctctaccggaatccaggacaataagctctcccggttctttcttattctactgcttccagaaattcgtccctgtatttccatacaatttcaatatgttccggatcataaaaatttatgacttcaatcagctcatgcagaacttcataagacagctcttccaatcccttatattttacaaaaagttgcagtccctctgatttctccttttgtttttcctcctccccctttaaaatttttgcttctatctcctgtatcttttgctgataagctgctattttctccatataggtttgttttcgtgccaggtaatccttcaaagaaatctgttcttctacatattgttcatatagttccattttctcctgtttgcaaagtgccagcttcttttcatattgctttttccgataccggagtttcggaatattcaaagtctgattggctttctttaactgctttatggtatcctctgcaagggctgcctgctgtcttatcataattagcaccagttcttccaactctttctgcttatatttctttggataacaggaagcattgggggctgtcgtaacacttttacaataaatcggcttttctttgtattctgtccgtatccgcattttccgaccacaatgcccgcagcggatcaggcctgcaaaaatattctcagaagacggtgtagacccatgatattttctgtccttctgtaccatgtcctggaccttctgaagctcctgctccgttacaatcgcttcgtgtcctccttttacgcaaatccaatcctctcttgaaatatatcggtactctctttttgacggaaccctggtttctgttttccctcttaccgtcagtcctgcataaaccggattaaacaaaatcagctttactaaatttccgtcccagaatttcacagatttctttgcttccggcgcccagcctttcctttgaagatatacggtaggtgtttcaacttcttttttattcaggtccctggcaatgtctgcataggtctttccttccaacctttggtcgaaaatcccccttacaacggaagctgcctccgtatccagatgaagttttgtatgaacaccgtcatggaagcaatatccgtatgttgggattgaaccatgatattgtcccatttcagcctgtttcctcataacttttttgatattgtcggaacaaatctggggataaatcccattgattaggttcttaaatttaatctccgtatcctttctttcggaaggtttctggctgctgtcataaaaatcattgattgaaatgaaacgcaccccaaggaacggaaatattttttcgatatagttttgtgtttctatggtatcccttcccaggcggctcaaatctttgacaatgatacagatccgttttctcctggtaatcagccccatcatgcgcttaaattccgggcggtcaaaggttgtaccgctgtaaccatcatctacaaagaagaaaacctttgcccctgcaaattccggctgtttttctacaaaatgctggatcaaaagcctttgatttttaatgctgttgctttcctccattttttctttatcatctctggaaagacgcagataagcaaaaataaaatcatactgcatacggaagacctccttccatattgaccagttctttttccagctccttttcaaataaatccccaaaccagaacacgatttccacatagtctttggaatataccgtaatcttttcaataaagcggtcagcaatccctttctctatcttctggaatctttggtactttagaagttcctctgtccagtccattcttgccttcacctgatctaacaggttctgtccacgaagctgtacctgcttcatattctgcttggctgcttgctgttcttcctgatagattgatttaatctcctgatattccttgcagtccaacagtccggtagcataatgctcaaacaagatttccagttttcttccatatttctcatacttctgtctggcattttttattttttctgctacctcctgctccagcttttgataaaactctgcaccataggtcttcttactttccacagcaagctggatctggtagcggagtgctgccttgactgcctgattgatgtagatttcattcaccgtgcggaaacattccgtatgatctgtaagggaaaaagaagggcatttataaaccatatatttatgtttctcattgcctccgctcctgcaccttccaaggcgttttccgcaatgtccacagaaaattcttcccttaaaagaaccatctgccccctgtttttcttttgggtttgcagcccagttatctaacgtatctttccagcgttcctttgcaatttcctgtgctttttcataaatcgcccgttccacaactgcttcccaggcattttcacacacttcccactgctcttttggtatcatctgaagaggaatattctgtgcaagcatctgttttgttttcccataaacagcagcaccaatgtaaacggggttctgtaaaatcttcctgataccgtctgatctccataaccgccttttttccggctcctttccctgtttccttttctgatagctgtcctccggtcctaatacctttctgccattcagttcccttgctatatcatagcttgacatttcttcaaacacataccagtaaaaaatctgcaggattatttctgcctcctctggttccggcaccagcttcttgctgttttcctctgccctttggtatccataaggaggtctggaaccccagaactctccccgctccctggacagccggtgtgcctgtaccagtttctctgaaacttccctggcataataatcattcataaagtgcttcaaaatattggtggtccggtcttctacacaagccgggttcgcactgtcatattcgtccataacggaaacaaaccggatatttaaagttgggaaaattacatcaatcaaatctacagcatctaaggcgtcccttccaaaccgggcaaaatcctttacaatgatgcagtcaacctttttatttgccacatcttccatcaactcttcaaatgcgttcctttggaacgttgtacctgtcacaccattatccgcatagacttttaccaccagcatttccgggtgtttctttgcgtagtcttcacagatctgtttttggatataaatggaatcccttctgccatgccctccgtccttttcggaaagccttacataaatataggttctcagatacttcatttccggcttgctgctttgtcttttctgtcctcttttgcttaccttaggcacttgcttccgccccctttcctttcaggaaggcttccacatgctgatccggctttgctctatttaccgtttccagcagtcccaataccttttcaaattcatcttcaaaccaaaaatgaatgataatgcgcttctgctcatatacctcaatccgtttgaccaggtttaccagcattaagcggtccacttccgtccggtcccggtattccagaaaatattccagccactcctgctgtttttcaagggtttcctgcaagtttcggatttccctttgctggcactccattgcctgccggatttcctctaaagactggtcatactttgctttgaaggtttcaaattctgtccggtccaggatttcttctgcaaaactgtcatacagttttactttaatgtttaaaatcctctggctctccttttccagcatctccagttttttgtcttcttccaaaagccgctgtcttgggattgaggcagtttttacatacgccagtatctctttcagctccaccagaacagaaatataatgcaggattgcctctgtcacagctcctaccagttttttctcactgatactatgggaactgcactgcttttcataaagggaagtcgaacatacataatagtggtggactttatctgggcttttcagtaccatgctttctttacagtccccacattttaccaggcctgaaagaagcgctagcccctttgcacctctcatggtatccattttcatcaggttgcccaccacttcatattggtgtctattgataaccggctcaaaagcattttcataccgtatccactcagcttcctctttgtggatcacaacctttactttatggtttggcgttgtggtttttccctgtatcagcactccggtgtagcgttcatcaagaaggatacgacgcaccatagttggcatccagaccggtttttccgtcagacggaaccctgtctttaatttctgttttaaatatacctgcttataccgaagaggcgtcaagatcccacgccggtttaattcttcggatatatccgtcaggctgtagccctgcattttcatgtggtaaatatcccgtacaacagaagctgccacttcgtccatgaccagcttatgtttatcctcttcggatttcagataaccataaaaagcaaaaggcgctacacactgcccggctgtcattttgacatacaaatgggaacgcacacttttggaagtatccgcagggtaaaggtcattgattaaacttttaaatctcagggtaaggaaatcacgatttggcgtgaggctgtcataattgtcattgacaaggatcaggcgcacacccattttcggcaggatacgttccacatactgtaaaacaccggaaaagtcccttccataacgggaaaggtctttgacaataatacagtctgcttccccctcttccagcatacgcagcatttcctgaaaaccggggcggttaaagtttgtgccggtatatccatcatctacacattcttttaccacctgaatttcagggtggctctttaaaaagctatggattagtatcctctggtttgatatgctgtcgctttccctgttatcaccatcttcgtcagaaaggcgcaggtaaacaaccgcacgatagatttttttaagtatttgatttttcattgtattcgctcctatcatttagattcgtcagccgattccctaaatgatagaggctactgggtccttgccatcatcctaccatagtccagaaggtttgtccaccctgtaatctgccaacaatccgctttcttccctatccctgtcgtggctttaccatttcatctgcacaaggctttgcatggcttcctctatggtacggttggtagaagcaaacccaatctttatggtgatccccttatatttcagaaaataagggttctttccggactccaggatttcccggactttctccggtttgctcttttttacatcaatcttcagtttctctacatcttgtatctctttcgggtcaatgtcctcaaacgtcatttcccgcatcttcagcagttcttcccgcgagagcattatatcccttccctggtacagcaactgcacagatacgcatctaagtcctgctcaaattgttcctgtttctcccaggtgtgcattaaatactgtttcagtctggcataatctaaaatcccataaccgatacagtctatctgcacctgaaaagactggagcagttccatagtctgtaaaatttcttccggacaataggataacctgctaagcccggataccacaatcacatcaatcatgccttttcctgcaagcactgccagcctctgccagttttctttttctatggaattaccacaccctacaccttccagtaaagtaaccacatggtatgtctgctgttcacagtaatgcaggcttttttctttttcataatacaaaagcccggcacatggaatgggaatatccagatacactgccgcccgctggggactgttcctattttctatctctttttttcctttgcagatccatgcagggaataacattcctccctgaaagatctctttatcttctgaaaacagtttttgtaacatctctctattcattgctctgcctcctctttctttggctcctgttttcattccagggctataaagaaaccggcgtttccccatagccctaaaatgaacccattttacacaccatactggcagggctttccctgccagcatgttttttattttctcaccccggtgtgaacgggagcatgtaggaccggcccggctggccgcctgacaccctgcagcaccctttcccgctgcagcatgtcccagacgctaccctggttgcagtgttttatgcaaaggtatcattatcattcggctttcagactgcctgccacccacagcctatgtccgggcgctgctcacactttcccttcatcttctacgattccttgtttgatccgcttcttttctgccttacctgctgccactgcggacaagtgtatcttcgcacagctcatgaccctgcatcatacaaaatagaatgtgccgaaatgttttgtgtcctttaagatatttctatagattagcgtcagaaatgacacgtttgttttaaaaaaatatcaccatactgatattcagttttcaaggttcttcccggctgaaaacatcagcctgccaaaagacaccataaccctgatgtgttttggcagactgttttcggtctgcatttctctttatttttttaaccggataatcatatctgcccaaaattccgtatatgcctgccgcatcaactccaaaagccggtcttcggtaattcccgtaatcacgttctcttctttcttttccggttttggttccggtacttccagtgcttcctcccgtatcttcattgtaagcatggataaggaaggggaattggcacagttgataaaaccgatataatggttcaccacatcataatcacctctgcagcttcggacaatatcaaacgcatggcggattgcccgttctacccgctgccctgtcgtgccattttgctgggctaccttaaagtacagatatgtggttttgatcttgctgtctttctccaggatcagaacacagtccacgatataaccaaatccttttacattggccggcattcccattttaaataatactgcttccaccttttctcttgataacatttcccttttcctccctatctgtattctcacttcctgctgtcttgctgatatttctttagccctttcttaattccctctatggaatagatcaaaaggctagtttctctttcatcacaatcctgtaccagataccagattttttccttcaacatcatatcttttttcgctgtacccatgtgtataaagtgttcttttatgggaatatccatagcttccaacagccggatataagttttcattcccataagtctggcatgtgtttcaatcttcgccagatgtgatacggaaatatctgctttctctgcaagctgctcctgagtcagtcccctggattcccgcaaggcttttatggcatctgctacaatataaagttcattctgcattcttttatctcctcgttgattacaggctctattataattacaaatcctttccctggtaatggactatggaggcaagatttcccagtttcattaccatttctttccttttttggttttagagatttattatatctgaacgagttgaaaacgatttttgcaccatttacgaaaaagcactgcattatctcttcaattaggcataaaaaaggagagaacgtcacatatcgactcctctccaatagcttctattcatctaagatatttgccaatacataggcttacttgttttttctttccaggaacctccgtatctcttccacactatctaatatgggaatgaacggggcagacgggctgcatactggatcttgactggacagttccagtgcattaataaatgcttctgcctttttggggtcttcaatcacaagctctgtaaggatacttgatgtagccatatagaaagcacctcttttctctcatatcttaaaaaattctttcgtaagaagatcctgcagtattttctatacgccaagacctgtactctccatttttatttatgtagtaaagtttgatccagcatgtttttaatttcatctggaagaccgtctaccgttgcattttcatctaaaaacagtaaatttgtatattttttcgcatcattcggcgctgaaaaaatatgagttactgtatatgctgttctacttttagaaaagcaatcttcatctcgcagcgattctactacaaagcaatcgcccttttgctgccccttatcatcatactctttatttaagcatagagtaaaattaagatctgttgtgccaaacttataagttctcgtgtctgtgacaatctcttccagcataaatccttctgagccagccagcattgcaatctgtccgatatgcttaatcttacgcttacacaatgaaaaagggtgctgcggtgtaaaaaatatctgcgaagcctgaagcattttttttgctgcataactataaaacttttttgctgaaaggttcgtggccacacctgtcaagtgcctaaaattggcagctttataaagcacctcaatatatctgccttcaaatacatatagaaatcttttacctactaaatgcttcctatacagatcagcagctactttaatctcctgtacaattttctctctatcctgttgttttcccatctatcttttcccaatcatcactatagtataaaaaaacagcactggacaacttttttgttatccagtgcccataatcttaaaaagcggttttatgctggctgtcagccgcgacatccttccgaatgtctaaaatgtcgccggtatcattgagtccccggcgcggactcaccgtatctccctggtgtgggcgtaatacccttccgagtatcaaatagtcccagtaattaccctgcccgggcacagtacagcttttacgtgccgctacacgaaaccttttggcttaattatattatatgcgataccctaagaaatatcaatagtttccacaaaaaattgattggttgtatcttattataacccgttacttaccgtttcaataaacgctccctagaagctgtatccaatactattttatgaaaatccagcattgcgtgctcttgcatcagtttctcaccaagtttcacaagaggattggtttcccattccgaatcaattcctgtttgatgatagtatcttgcataagcaaatccctcagctaccgcatctgaattttcaaatattcccactattgcatctgtaaactgtacaatgattgagctcccaaaaatcccctgcaattcttccgcattcgcatcatcatatttctctacatcaaaagacaaagagaaatcatacgtattctcttttccgtcttctgtttcataagaaattgttccaaaaatatctcccttgccagacggaagttcgattgactctgaaagctctaattcatattcaatgttattgaacactgtcgttgcttcaaacatttgtgatatacaggtaccttctttttcataaatatctttctgtaaaaaggaaataggattatactccatattttcccatatctgttttccctccactgtccgtttacacaaggaatctaaaagcaacatcattgtttcctgatctatttcttcatatacgttcatagtcagcctcctttttctttggatagtccacaaaagctctgtaagagtttatctcaatttctagttacaacgtgatatttagtcaaatgacgtatgtacgcgctttcttatagttgccaatattatatggcgtatctcccaaaaattcaatcagaatataaaaacttttactcacactatcctgcctttacatcttttttagtctataccctacattgatcaatgtttctataatatcatgccccatcttttttcgtatcttccatactacgtgttccactgttttgtacggaatctgatcatcataataattactctcccagaccgaacaatagatattcttctttggaataacccaatttggcctttgggctaaaagatacagaacttcaaattccctgggcgttaaatctatttcctttccttcgtaaataacctgataggacattggatttaactgcagttttccatcgcccaaaactacattctctttatattctggaaaaacatacttcatctgtatgcctcctcttgatttataaatttctaactgttcccattccagaaagaaataccgaacgaaatatccaacatccggcacttttttagttatttttactttttacataatttctatctctgccatcttttctataattgtgaacttcctgaaaaattaactctcattttctaaaaatagtttatttcagccgtttacagtgaattttataaattcctcgtagagttaattaactctcagaattttactttaaatccgatggaaacattgaaaacactcagttgtttcaatcgagcgttaattttcacagaagttcacaataatatgaatatgcttcttacttttcagattagatatgttccgttttatgcaagcgcctaattttaaagttgtgcatatccaccgaatattcatcctataaataattgttgggaaatgttagaacagcagcatttctctctatttccaaaaggagagtaggcatcatgcattaccctttattttttaggttctcttgattatataaatcttgatatacactacaatttttcaataactctgcatgtgttcctatacctactattttacccccatctaatacaattattttattagcatcctgtgcaatttttactctatgggttatatatattgctatcttatttttactcacctcaaaaaaactcttaaaaattttggtttctgctgttacatctaatgcggaactaggctcatccaacaaatataaatctgcatttttataataggttcttgctaacgctattttctgccattgaccacctgataattgacctccttcatcaaaccaatttcctaatcctctttttagttcgtatcctctttcggtttttaaaaaatcaacgtttgctttgcacaatgaatttttaattttattttcatcgacttctgtactaatatctcctatataaacgttctcttccaatgtaccttcatactttaaaaaatcttgaaaaagaacagatatacaattcctgtaactctttacatcaatattctccaaatcaagattattaacaaatagcttcccactagtaggtttatataacccacataaaattttaaataaagtgcttttcccagatccattttttcctacaattgcaatctgttcgtttgatttaatttttaaattaatggtagatagtgccattttacattgaggataatcgaaagatacgtttcttagttcaattgtctttatattatctacttttgtaccacctaacgcattctccccttcttttatttctaaaaaatcttttagtaattgtatatataaatttgcgttataaatagaataaacattagaggcaatgctatttgtagcattttgcatcatggacacagcatttaaatatgacatagtggttcctatcatttttttccctacgtaagccaaatatattgcaataatcattataattatacaaactatatcttgtataaacgaaataatcatatttaaaacagctctggttttttcaatttcattggcttgttttatgaaagttttgactaagctacaatatttatccagcaaatatttttttaatccatatgcttttacctctttaaatgctgtatcatgtgtaagtaaatatgtataataccacgcttttctttcttttccactgcgctcatatctcattagaaattctttattaccaacataaatttgtcctataaacattaatattgacacagcaatcattataatcacaagaattggattccatgaaagtagtatcattgcggctgaaaataacgaaactaaattagatgctaagcctaataccccttgcatggtctgatatggtttatttccaatttcttgttctaaacgatttatcatatcatatgtttctgttctctctaacatttccaatgataaatccccacattttttcataagaatgtaatttattccataaactaaatgattgtttaaattgtttaaattatagcttgctaaattctgtaaaagcgattccgagataattagcccgaaatataaaatcaaaagatacaccacatattgatatgattgtgtcttgttttgtatttcatttaacaactgttgcattaccaataaggacgaaacaggaagaattccatttattatagacaaaataaatgccagaataaattttgctttacatattttacaaattaatcttatcgtataataaatcaaaaaaatattcctttttattttttttagcatgatttttctcctatatagtgaaggcgtagcacatatagtactacgccttcgtttttactacctcttagagagtactagaacggaatgtagcaacagcatttactctgttacctgtacgatactctccttcgccaccacagccacagccacaatgaacacaaccatcatcattgcctctgtaacctgcatatccatcagtacacatgcatgctctcggctgcactcctgatccaggtgttcttccaattggatttacaaacttcataacgattcctcctttctttgtaatttaaatacatctatgtaaatataaacgtatttacctttgttaatgaatttccatttcattatattgttccaattcgcttggatttgcctccattaatgcatgatatcgtcttaaattgtcttccaaatactttctttcgtttcgacatgaattatgtcgatatgaaagatgtaatccattagcatcgtagcaattaacataacataatgtacataaattaactgcccaacattctttacaatactcttttgcttcttctataaagtcttcaacataaagtttcttaattttttctttatcaaatccctcattcacattgcctaaacaaggtatatttcctactttttcacaatgtaaaaattcaccttttgtagtgacataaatccttctttgtcccggcacgcagcatccattcattccatactgttgaataggtgtttctgtcaacaagcgtttgtgtataatcatcattcccttatccatataaccatccgtaaacaaagttttttctgtattatctggatttgatttatacacttcttcccatttcattaaaggttcataaaactcttccataaaccatctatcttcttttccttgcggtaaaaagtaatcactctctgacggtccatgatctaccgttgcagtcaaaatcataacgtctttgggaatccattcacttttttcgataaactcctgaatttttgtatactgttcaagataacctggtcccgatacaaccatattaaatccaatcttagaactctttccttccttatggaatgcttcaaatagtttttttgctcccataactgttttttcaaagctacctgtcccattaaccataagccgatttgcatcgtgcatttcctgaggaccatccaagctaataataatattgaaattatttttggcaaaatactctgcgatcttatcatttaccaatgttgcatttgtagtgattgcaaaggacatatcctcgccaaataattttttagcatattcaactgctctttcaataagttcaaaatttagtaaaggttctccaccataaaatccaatgtgcctattttctgcattttgggaatgctcttttaaaaaatcaatagctttttttgcaacatcccatttcatgttttcatgtccgaacgccctgtattctggatgagaaggatgataaatacaatatttgcaacgtaaattacatttttcagtaacttcaagagtaacattctcaaccttattttcaagaatatcatctaactctgttactgcatcacctgtcagcgtttttaatggtggagcttgtaaaatatgttcattttccattgccgacttaatttctgaaattgcatcctcaaactcacttttacttaattgaagatttttaatatcttcgactggcattccctccaataaacttttcagtacaatgtaaacgttcgaatttaatttggcaacttttccagttcctgtatcataaaaataataatttttttctgtcttaaaaactttacccaagcgcccaattcttccatttttttcgatttcagataccagcgattctaaagatatttttttctgctctttcactctaaacactcctttcatttggattttttattatgaaccgattatatcaataaatcccccaaaatatattttgatgtaacaatttcgatacttgatgtaataaatcctctatactttatgaatatagccctttttccttatatttacatctggtgcctacaataagttcgaactgtaagaaataagaaaacaggaatctcaatcaatgcggaaattaatatagtatacggtgtccaaaaactcattcccccaatatgtaggtaattaaaattgataagttgatacagaaaattattttgcataccaagtcccgcagatggaaaaatagctgaaatccaatttacccctaatgctgtgtaagcaaaagtcggaataaggactatgccaatagcaatcaacaataccgtcaatgtatctttgcattttgctgataaaaaaaaagtacagtaaacacaagctaaaacagatatcaaccctactaacgaaataacaatctgcatctgtgctaagtcccagtttggcaagttaataatagaaaacaacatttgaacagaagattgtaaacaatttgttccaaatgtgatatctgaaattgctaagtgcagtgtaatacacatagtatacacaaccatcacaatcatactggaagccaatatctttgtaatagctaatctggtacgaccatgctttgcacaacgcaaaatactatccgcgcctgattgatattcaccagaaaaaataggcgtgataatggaaacacataaaattgccaaaatcataatataaagctcaacatagtcaaacgcgtctttggaatatcctgcataaagttgaaatggcatatcgacttttttatattgttctaaggcttgttgttgtgcggccggatgattgcgttgctcattcctcataacatctgccagatgagtttcacatttctgataataattttgtgcaacatcttctggatcaatatccataagatcaggtcctattccagttaacggatcagcatatagttctggcaacgctttaagcaatggacgaataggtacaatctgtttaatactgacagaaagcggaaatgtgtcactttccataggaccatattcgtttatcaaactttgataaattctcaaagcctcactcactttttctggagtaacttcgccatttatagcagaatataaatcacgcttaaattcgattgcctccataccatcaagttctgtttttgttccatctgggtttggacgatttatggactcaaaagcaatcggcagatatgccataacaacagacataaccagagccacagcaattaagataagtgtgcgtcgtgatttcaggacacgctttacttctaaacaaaataaacgcatattatttttcctccctttcgacatcttcttgtggaaacaaccataaatacaaatcttccaaacgcggctccgcaagaatggaaccctctacttcggagtgctctgcaagataacgaatagatatttgattattgtcctcgcctcgctgattgataatcctcagacgcatttcatagtccatcatcttatgagcaggaatcgcacagctccatactttcccctcaatctgttttaccaaatcgcttgttgttcccacatcaataatctttccagctttcataatcgcattacgagttgcaatatattcaatatcagaaacaatatgcgtagaaatcaacacaatacggtcatgggaaaattccgaaatgaagtttctaaaccgtactctttctccagggtcaagtcctgctgttggctcatccataacaagaattttagggtcattcagcatggcctgtgcaattcctacacgacgtttcataccaccagatagttgtgcaattttttttcgcttcacatcagaaagggtaagaatatccaacagatagttgattttctttgtggtttctctgagcggcacatcctttagtgcagcaacatattccagatagtctttgaccgtaaaatcgcgggaatagccaaaatcttgtggcaaaaagccaaagatattgcgataatctgctcccattttatgaatgtctttcccatccaaagatatacgaccactactaggtgtcataatgtctgcaagtattcgcatgagagtggtttttccagccccatttgcccccaataatccccatacgccagttgttaatgtaaggctgacatcatcgactgcagttttatctttgaactgtttgctgatgtgttcaatctttaattccataggtgtactcctttctcttaaacaaaaaactgtccttgttcagtaactattgtaccgaacaaaaacagtttaatctcaaagatatggaacaaaatctcctaagaaattcctaagattttacttctaaatgcctaatcagaaatgggaagcataatcacaaaagacaccatctcattttcgctaaacgcagtaatggttccaccatgtaatcgtataatttcctctgcaatcgacagtcctaatcctgcaccgcctgtatcagaaaggcgggcttcatccaagcgattgaatttttcaaatatgccagaaatttgttcaggttcaatagtccgtccatgattttcaaagtttatttgaacgctattaccacaacgctttgcagttataataatctctgtattaggatagctgtatgccgctgcatttttcaaaagattactaaaaacccttgccagcttttccggatcagcatatacaactaaatcatcatcaaccgtaaaagcagccgaattgccttttgcagataaagagggatatatttcatcaactacctgtgccaacaaacactgtaagtctaccttttctttctttaacgagacagtgtgtgcattatattttgtaatttcaaacaattcattgataagcttttcaagtcgttcagccttacttaatgcaatttgaacatatttttctttctgtttttcaggcatatccggtgcttcgtggagtaaacttaaatatccaatcactgttgttaggggagtgcgtatatcgtgggccagatacataacaatttcatttttcctatcctcagcttcttttgctacctgtttgcttaacaacacagacagtttaatctggttaagttgttcctctaattctttaaggggatcagacaatgctacaggatgatcattctgctcataaactgtctgtgttgcggaaataacttcatccaaatatccccatggttttttccagaagtaattaaatatacatacaaaaccaatgattagatagaaaataaaaatcatatctatacgccagtatagccatgataaaattttgctatcgaatttcggaaaaatgaattgtgccaaaatttccagtcctataccagttacagtatataaaaatagtactaaatataattgtactccaagccgcttttccgtagtaagttgcttttttttcataagcacgcctccaatcaatttaaaaataaaagaagtgccaacagaccgattatgaaggtgctcacaattacagcaataaccaaaaataatttatctgctttttctcgactttttagcaatcgagccacaatagaatataaagcaatacccaaaagaccgcctgctgtgttagtaatcaggtcggtaatatcagaactaccaatagcaagtatatactgtgtaatttccagcaatagacttattccagcaattatcaataatttcaaataggatttgctcttaaacaaaagcatttgcagatatatgcccattgggacaaaaatcaataaattttcaagaacttcttttatgtgaaaatctactccaatctctttatcgtaataaaatggaataatatttatctttcttacagtgtctaaatcattgatattgaattgcagcttaaataatattatccaaaccaaaagtgccagataaatcaaaaaaagaactgacaccccaaattttcgctttcttttcatgggttctcctttcagattttataacctactccccaaattgttttgatatatttcggggtatcagaagtatcttttaatttttcacgcaaatgtcggatatgcactgtgatagtgctgctattttttgaataatattcctctttccatactgcatgaaataaatattcaatgcttacaaccgtcccggcattttccaacaaaacattaagaattgaaaactcggtcggagtcagcgacacattctcaccatccaatagacattcatgtgtctgcacgttcaatcgtaatttattgtatgaaagttctggctttattccttcttcacttgtaacggatgaatattttttgtagcgtcgtagctgggcttttactctggcaaccacttccaaaggacgaaatggctttgtcacataatcatcggcacctaatgtaagtccagtaattttatctgtttcctcaattttggcagttagcataataatggggtaagtatatttttcacgaatacgctgacataaggaaaaaccatttatatccgggagcataatatcaagaatagcaagatctatatcgcccttttcaatacaaggtattgcatctttagcacagtaatatttataaacaatgtaattttcattttgcaaataaacttccagtaaatttgctatatccttctcatcatctataactaatattttttcgcacataccatcatcaccctctttccataatttgaattataacaaatttcctttatttattcattatgattttcattaaaaactattaagattttcataagaacttttatatatacaaacacttctgccttttcgtgctatttaattataatcctattaagaattcttgatatcgttatataaagctctattacttaccagatgttttttgtacaagtcaacatctatcttaatttcctctataattttttctctatcttgttatcccatgtccattatctttcaaagcaattttatgctgactgtcagccgcggcatccttctaaaattgatttttaagctaaaaggtataaaagcaagctaaagttttccctttcttttctcaatattatgtgttagtgatttcatgagatgtcacaagattgctcacatcagttgacgctcgtttggttaactttctgtcaccagtcagttaggcaataccgcctgtttccaggcggtacctgctttatgaagttaccatcctaagcatctcgtgttccacaacgaacttgatcatataatcatcgatcaatcgtttctgattttgaaacgcatacatcaaagctttttcacagacacggttgatcatccgtgggattcctgcagatgccttatggatctcatccaatgccttggttgtaaatatctcttgcttacatcctgtacagtgcatatcgatgcgttgacggatgactaactgtttcttcacacgctttccttttgtatgctgatggcagtatacaggttaattcagagacaggcaagtaaatcagttgtttgatgattcatgaggtcaacaacaattatggtatctttgtattccgaaaaaatattctgcatcttttcctcccacaacagtcttttctatatttctgtacagttttaccattttaaataaaaaacgcggaaacaataatattttatcattcccgctaatttttctctttttcaactttatactttatgatgccgatacattgtgatataaaaacggtcaacgctgtcaacgcaatcaaggataaatattttttcatacctaaagctgtacaacagccagcagcaatgaaaatagctcctagtattttacctgttacttttcggcaatgttccttttcttcttttttcaactcatggttaatgttttctacaggagaaagtttccatatacaaatggaactgaccaaaataatcccccaagccacaaacagctctaatggatatttgttattaatttgcaaaatcataacttgaacagtaacagagcatataaaacaagccttaaagctattcagatgtacaccaccagcataggttcttaaaaacataaaaacacctgtagacacaaggaattctgggattgtatgcaagtatatcgctatactcatacagacgaataggcaaattaacatctctaatccaatctgaaatccatattgatatactgcatacaattcctctgaaactgcaccggcatcaataacgtatcttgttattttttccgataatcttcccatgaaattaaagtttcttcatttttttcaatgcttctggcatctttggctgatgataaatataacagcaagcactgtccgctgacattttaccaagtttcagagataaatttgctaatacttttgctggctgattttttaaatttttagatttcataattaaaatctcctttcatttgtttaccaatacattactacaaaaaatttcccattcggttctcttgtaaaaaaaccgagtattgatgtaatttttcccaaaaaggcagcaaaaaagaagcaatgtttctccggttctttctcaacattgcctcttttttgctgatgtatgtttttttatataccaattccataaaatcaggttctctatctttttcttatattttcgtgtgttatctattgtttctatataatcgtaagctcctgctttcagtatagaaaaaatatcctgtattgatcccccttcgctaatagcaagaataggcgttaaatgccccaaactcccttttatttttataatagccgcaaatgccctttccctctctattatctctttagtaaaatggaaaatcacaacatctgccgttggatatctattgttttccaactgttgataagtacaccattttaattggtgttttttcccaataatcctttcagtactgttatacagtttctcatcatcactaaacagcaatattttcacgctatccatatatcagtccccataccgcataccaaatttatctttccattttaccattctttcctttctcattattttttatgtaattatttcgagtgttcatgtaattattcctgcacattactatataagactatccgaattttaaattttcctggttctgaatcctctattaccactgatccatgatattttgctactgcccgatacacagaggctaaacctactccatgattttctgcatctgactttgtagatttcaagcggttatctcttgtttttaacagcttccctttataactattgtctacgaacaataatagattatttttatcaaatttcattttgacatttatatatctattttcttcaaccttctctgctgcttccactgcattttccagtaaatttcccaatatcagactcagatcagctcctttaaaaggcattatcatcggaatacaaatatccgttttaaaaattattcttttgttttgggcagttacataccaatatccaataagtgaatcaatcacaatattcccactattcgatattgaggcaatcaccataccgccctctcccataatttcttcaataaaacctgtcattttttcatattctttattttctgcataagcaagaatggaaataagattattcttcatattgtgttttatatcccgcaactgcaacattgaaagttctctttctttctgatgacgttcgcataattccagttgctgttcatatactgctgccattctccttaaccgcaaatcatcagccaacttcatatagacataaaatatcaatatgttcataccaagtaaaataagtacagtaaatgtagagtttatacgagtacgtccattattatttgcaaatccaagcataaatatattgttcatgatataaatgcttcctgttgggatcaacacaagtaaaatactgtatctgaccggcaattccttaatatcatcatctgtgaacactttctttaatgcaagaattactgcattaaaaaatatttttgaaacgaaagagcctacttggcgaactgcagcatattgagggcagtatgttagcaaaatatagttgcacagggtttccatcaacatccaaatcgcattaaaggtaattacaaatacacctttgttccaccatctaccttcataagtcatcataactgccaaaaacgtaaacataatcgtcacagcaatattgatgtaggcaggaaaactaataatcgttgttattccaaattgccaaatcacgaacagcgttataccgatcaccgacaaatacctttttctcttacgagcaaaaaatatatcgaaataaaaaaagaataaatatatataaatgtcaacattaaaatgtacatttttgatcatttaagaatgtacatttttgctattcttcctcttgatcggtatatttttttaagcgataagattttcctgtgatatttaccacatgtgcatgatgtaacactcggtcaagaatcgcatttgcgatcactggatcaaaaaatacatcatcccatgaattaaagttgatatttgtggtaatgatcgtacttcttttttcatatcgcttgtcaatcagttggaaaaacagctttgcatcatcttttttaatcggaagataaccaagctcatcaatgatcagcagcttatatttgaaaaagtgttttaatcttgcttctagacgattctccagttttgctttttttagctgcatgatcagatcatggcatttgataaaatatgtactgtaacgtttttttgctgcagttactccaatcgcagtggcaagatgtgtcttacctactccgctcggacctaaaaacacgatgttttcagcattttccagaaatcttaaagttgcaaaatccttgatctcttccggattgacggatggctgaaattcaaaatcaaagtcactgattcctttttgatgagggaaagctccgacttttaccatggaacggatcatgtttgcttctttaaaatcaatctcataattcgttagtttacagagtccttccgtaaatgataatggtgacgaagtgatcagatcaatcacttcatcaagatgaagatccatctgattcaatttcagatactcaaggtttttctttaattgtacatatgtgctattcatttttaaacattgctcctatctgtgtcaggttttcttttgcgatcttttcaatatccattgtctgctctttgaatgtctgtttactgatagcaacataatgatcgtgtgtataattaagtttttttgcactgatcggatgtatcacgatcagttctgtgttataatacacatacagataattatcatatacctgtaataccagacgttttccaagatattttggtggtacggaatattgattggaacgataagtgatcatacaggatgaattcacttttacagttgtatgggtcatctgataaggctttcttatcacattgcgtggaagtggtgataagtgagccttttctttttgaagatacatcacagggatccttccggttcctgggtgcaccgcatgattgatccgttcattcagtttatggaccagttgattgagctcatgataatcgagaagtccgttataagcatagatttcatcgagcagtttcatcggagcttctacttttgcttttgtctgaggccgtgcagcaatacagggtcgtaccttaaatccataatctgaagcaaactgggcaaagcgtggattcacttttcctttactgtaagcagtccgtggctgatccatgaccgtcttcatgttatctgtcagaagttcttcaggaactccaccgaatgtttcaaaggcatcatcgataaaggaacataagatatcctgtgttttcgataatgataatctgtaaacacgaaaccgagatgatgacagcagcaatacaaagatgttgatatcgatccattcaccggattttaacagaaactttatggattctttccagtccagctgtgcctgtttcccaagaggagtttcaaaacgcagatgagatttctttttgatatgtcgtttctgccttcgttcaaaataagactggaattccgaatgctggctgatgtatctgcggaaacttgactgggcacaggaaagcccatgattatcttttaagaattgccataaaacacgtttataatagaaaatctgctggttttcatcggaaagaagatctttgatgatatcataataatcatcaatgcaagatgaacgcctgcgggctgttggtttttcatatccttttagatatttatcaaccgtccgtcgatcttttcccagctctctggcaatctgacttttattaattttcaatgtactgtcctccaaaaaaggggttagttttaccagatcccttaaagaattgatctgaatgtcactagtaatctttggtgtatatatcataataaattcctccgtagagaatttattataatgtgattttgtacatttttaaatgatcatttctgtacattcttatattagcatttataaatatactgcccaaaggcaaagcaatatatctatcccacacattaataccctattcgtccacataaaacgtatcctccatagaacaatattgttcactaattatctttctccggtcttcactgattgaaattttttgtccattatccattactacagaatcataagattgtccggatatatgtttataattcaccagaaaagactgatgaactcgcaaaaaagaaattttacatgttttaagggtttcttcaatctcattaagttttccgtacagttcaaggatttcttgttccgttacaataaatatttttcgtttgttgctttcaaaatataaaatatccttgattggtactttatgattcatacgttgataactatagcgaaaataaaaatcttcactattaatgtcttcatataccgacttaaagcacttttccattattttatctgttacaggttttacaagaaactgaaacggtcttacctcaaaggattccctcatataactttcatggctcgtaacataaataattcgcacatttttatcgtatgttctaattcttctagctgccgaaataccatcttctttatccatttctatatccagataaataacatcatacctctcacctgctgcgatagcatctgctaaactctttccattccagaatacttctatttcagtatcaacaaaatttcttttagctatatcctggagaagtctttcgatttttccagttatttgaatatcatcatcacaaattgctatatttaacattcactccactctcttctgcatgtttgctgattttttcttctcactcgttttttttactatttgtataattgaccaaatcatctcctgatcacatggatctaactctttatacacttccactaaatcgtaatattcgtctagtacttcgttcattttcatctgcccattcaaatctctttttacatctgaaactcccagcaaataatctgttgttacattgaagtaagcagcaatctttttcagaatatctacttttattaacgtaacatctctttcgtacttactcaacatttgctgtgttatccctaattctactgcaaggatttcctgtattaaccctcttttctcacgtaattgtttaatacgactttccataattgcctacctcttaatcatgttgtactatcatgctaccctatttcattcatagcgatacaaataatagaagtaatcaattacgcaaaatatgcaaaatacgaagacgagcagtgcaatcgcactgctcaaatcttattcatgtagccatataaatgatgttgttgcggaatatatttcctgataaataatatccgccatttcactttcagaagcttctttatttttttctcctatttctcttcccacttcattgttatgtaagtccatatctctatgtgctgtttttggatatccgtctgattctgttcctgtaacatctttgtcttcatgagcagttgcaaataactctgctctttcttttcctattaaaacagtcatttcagcattccaaattccatgacgaaaagcatcacttctatttcctaaaccatttgtcccaaattttgcctctgtctgcgaagtagcaatattttttgctttatttacctttagggcatcaaaaggataacgaatacatagtttcttttctgaatctgtaagcgcattccaaatatctataatccccctttccacatcttgatgattggcttccaaaaaagacatgagcatttcttctgaataatctgggtgagtagccttaatgttctggatttctgcaatcaatttttcaaaatccctttcttctgcaccaatcaaatcacttctttgctggtcattttcgcttgccataacagagaatggaaaagccattatcaccaccagcattaggctgaatactttaaatagtttcttcatagaatatacctccgatctcatattatgattatattttaccatatttaatgtactatcccatctacatgtaattttttcgattccctgtgtaataattcccatagaggcattttcaaaaaaaagaatggcagtattaaacaaccgccattccactcttcatatactttttaccacagtaaaatgcaaccaaacctgtatcttccaaatttacccatttttagcattttctatctttatttcacttctatttttactgttcctgaaaaatcattacctacaatcccgatataattactgccatctggtaatgttattgtattttcataagtacctgttgtttttattaaagttttaggttcattgctaccagaaataatgaatatttcagcttctccttttgttatttctaggttacaaaacaattcaacctgcttccctgccgctctttctattgttgttcctccaaaaagatattctgtatcagaaaattttttgtactctgcttgatatgtccccgtataataatcttccccataatctcttttcccttgcaggtttatatcattggttaattgtacttctcccaccttttcgactactgcattatatttttccaacacctcctcttttgaacacccagacaataacaagcaaaacattagaataaagaaacaactttttttcacttataaccaccctttctttggtttgactttttttgtttttgtacgagtttttttgttctccttttctttcattgttgcgactaaaattacagaaatagcgacaataattatcaagctacataaacacaatggaaaactccattgtacggatgtatcataacttctatacccaattaatcccagacttgcagtaataggatatatattagccaatgtcatatttcctgctgcaaacatacctccatatccatacacaaaagcaacaatgacacctatcataaagccgcctgatagtctgcttgttataacaataattggtaataccgctagatacaaaagtaaattttccaatgttatttgtactagcccttggattaccaaatttactgtaaatccaggaaaaccaactatacactctgcaattaacgtaaatatcgtacaaataagcccaaataatattgataacattgcacatacaataagttttcctaccaacaactttttaaatgaaattggaatggtaataatattcttcaaaacatcgtctttttcttcccgcaatataatatatccagcaatcaaagctatgcacattgggaaaatcattgacatattatttttgattacctgctctattaagtatcgaaaatcccatacagatccatcattagccatagaagtaaaaagtgtcaatagaacagagagtagcataagagctatccccgcccatataatatgataacgttttaatttcaataattctgtttttacaatagtcctcaattttattccccccttttcttgtacaaacagtcaattaatagtattgaaattcctgccataatcccaagaattaatattacttgaaaagttgaaggaattaatccattcatttgtacaaggttcatattaattccatgtcttttcatatctccagcactccaaaatgttgtaagcggcgtaggaagtaaccataatattgtctttggtaatgcatcgaaaagtgctgttgcactcatatttaaaacgctataaaaaatacataataaaacagagaaaacataagtacgactaaaaaataccactataacaatcaatggtaatgttcctgcggtaataaatattcctgtttcaaccgccagaaatattttgtatcctaaaccgtatacatctaacgtaaacataccaaccagaactgttgctaccgttgatgctatgcaaaatacaacgcctataataaatagcactataatttttgctgtaactacttgcgtactggatagtgggattgttttaatatttttaaatgtatcattatcacgttcaataaaaaacaacatagcagctactactccgataatacagggtaataaaaattggattccataccccaataccatattaaatagtccgtcaaatgcgtccgctttatcaatatattgctccatcatagctggtgttgtcattaaataagccaatggaagcggaaacataaatgcagctaaagttactaaaagaataaacttttttcttttcagtttttgaaattcaaccttaactaatttaagcaattccttcacctccggtcacccttttaaaataatcttccaatgtttcttcgcataaatgaacttctgtaatttccaatccttgctttacaaaaacataagtaatttctgatctagggattgttgtattatataattgaagtctatttttatcacatatttgaaaatcatcacattcaaattcttttcttaaaatttccgctgcgcgctggctatccgataccataaaattgacatagcgactattttttttcgccaattctttcatactttcttcttcaagtaaaattcccttatcaataatccctatatcatctgccagtaattctatctctgataatatgtgactagaaatcaaaatagtttttccctgaacatcacataactctctaataaacgaacgtacctctgcaatacctataggatccaaaccattaataggctcatctaatatcagcaaattgggattgtgcataactgccaatgcaatggccagtcgttgtttcatcccaagtgaatattccgcaaataactttttatcacgatagggcaaaccgacaacttccaaagcatctcttacacacttacttttatttaatcctctaagctccgcaaaaatacgaagattttcagtcccagtcaaattaggataaaatcctggtgattctattaaactacctatatgcggtaaaatatctttactattggtttccatacttttcccaaatatttttatgtttcccgatgtcggttttgttaatcctaacagcattttcattgtagtcgtttttcctgctccattacgtcccaacagtccataaattcttccttttttcacatgcaagttcattgcagaaacactcttttgctctccatactgttttgttaaattattggtttgaataatatattcactcatttttttatacctcctttttttatactgtaattatataccaactacattgagatttccttgaagtaaccttgaggtaaccttgagattttcctctttctctatacttctttttccacaagatgtataataatttaaactataaaattttaggagataaaaatatatgtatgataaatttatacttatcgttgatgatgaacaagaactactcacccttattaaaacaatatttgaaagagcaggctatacaaaaataatgaccgcaacatctggagaaatggctttacaaataataagagaaactctacctgacatggttattcttgatgttatgttacctggtatggacggatttgaggtattgcaagaaatcagagccctcagtaaacttccggttcttatgctgaccgccaaagatgcagccgaagatcgtttttctggttttgaattgggagcagatgattatttaatcaaaccatttttgcctaaagaactattgttacgtgttcaagctattttaaaaagaagttatcctacagagaaacgaattatagaattagaaaattcttttatagatattgataaggcagaaatacatcgtgaaaataaaattattcctttgactgctaaagaatacaatatattattaaaacttgtagataatgccaatcacattgtaacaataggaactctttgccaaactgcttgtggtgaaatgtggcaagggtatgaaactaccctcatgacacacattcggcatcttcgagaaaaaatcgaaaaaaatccttcttctcctgtttcactgctaacagttaaggggctaggatataaattgctagtgaaaggagtaaaataatgaagcttgccaagcgtttttttaaaaaatatcttctttccacccttattatattgattttattttttgtactaaatattattttaatatgtgggactttactcatggcatggaataattctactgatccagatatacccgtccaaaccattagcaaaaatatcacgctcaatgtagatggaacaatttcttctactgattatatagaaaatattctaaaaaataaaagtgcctgggcgatgattttaaacgaacaaggaaatgtcatttgggaaaaatttttacccgaagaattgccaagaacctattcaaatttacaaatagccaagtttagtcggtggtacttacaagaatatcctgtttttatccaagaacattctgccggcttattggttatcgggtgcgaacctaatagtataacaaaatacaatttttcaatagatattaattatattcacagcctaatagtcggtatctttttaatgatttgttttaatatattactgatatttatattattctggcgtaatacacataaaatagaaaaatctatagtgccaatcattgacggtattgactctattgctcagggaaaacccattaccctttcagaaacaggtgaactttcaagtataaatgctgaactaaataaggctggaaaacatcttctacaaaaagaacaggcgcgtgccgaatggattaatggtgtttcgcatgatgtccggacacctctttctattattttgggatatgcttctgaaatcgaaaaaaatgaagatgcttcgcaacctgtacaactacaagcaagtataattcgtaaacaaagcgaaaaactccgtagcctaatcgcagatttaaatttaacttcaagactagaatactctatgcagcctttaataaaaaccagtttttctcctgtggaaattgcccgccaagtaatcattggctttatgaatggaccaatagacaacaaatattcttttgattttcattcatcatctgatacgattccagtattgatcaaaggagatacggaacttttttcaagaatgctaagcaatctaattcaaaattgtattaatcataatcctcatggttgtgaaataacagttgaaattttaaaagaaaatgatacctgtattatttccgtcattgataatggtggcggtatgacttctacacaaatagaaaaaatgaatagtggtatttttcctaataatatgtacaattcaaatggggagtctgttcatggatttggtctaaaattggtttaccaaatattaaccgcccataacggaaatatcaaatatgaaaatatacttcctcatggcttaaaggtcatattagagatacctattgaacatattgatccgtatgaagaaaagatctcttaaaagaacaggtgaaagccattatctgactttcacctgttcttaattatttacactatcataatatgcgccctttaactgaagtagttccacatgtgttccggattcaattatttttcctttttcaactacgtatattgtatcagcatcttgtatggcattcagtctatgtgtaactacaatctgggtaatatgtagttgtttcaaattattacatattcttcgttctgtaagaggatctaagttgcttgtggcttcatcaaaaataataacttccggtttcagtgccaatgctcttgctatagcaatacgctgtttttgtcctcctgaaatgttctgtccattttctcccacaaatgtattaagtcccaatgggaatttttctatatcatctttcagttctactaaatctaaataatgatatatttcctcatctgtcaacgtatttgtaatatccacgttttctctaattgttccattcattgccattggaacctgagtaactatggcaaatatccgatctatatcctctttgcatatttgttttatatcttccccgtttactaaaatttgtccttgataatgagaaaagacgttcaataataattttgtaattgtagtctttccacttcctgaacttcctacaaatgctatcttctcccccttttttagcatcatactaacattctctacatctggcttcgtgcttccatagtaagaaaatgttacttgctgcatttccatagactcaaatgaattaatatgctgagtaccatttttacggttagatttataattcattaactcttttaaacgaatcattgtttcctttaaaacattaatttgaggtaccaccaaagatagagtttgaaatggacctgtaaaatatccggcaagtgtgacaaaggctattaacgttcctaattccaacctattatcacaaaccaagtatcctcctataacgtaaagtatcaatgaagaagctattgaaaaagcccccaccaccgactccataatatcacttatttgtacacgctcacgtaatctcttaattaaatgcttataatcctgtttcagactatcactcagcatattctctattctcatgcaccttatttgctggatattagtcaaagtttctaccattcgtgcctgtaatgcactctgatctgcaatataatttttaacctttattctagctttttgatttaaaatcattactattgttatctgtataacagtcattactattataactgcaaacaatggtattgactgtgttatcatcattattccgcaaaaaacagcagtaaccacatctatcactgttgaaattagagctgttgatataaattcgtatatatcactgacactattaaagcgattttcaatatctcctgatgaatggctttcaaaataacttaaatcaatatcaaatattttattcagcattaaaaatatagtatctttgtatatattattctgtaaaataagtattaccctttttttagctaaatttgcaagtaaataacttaatgccactgataatatcagtaacgcatattttacaaaattgaagcctaatgtatcatacgttatttcattgactattttttttataatgagcggtggaatcaatataattccctgtgtaaccaacgttagaatacttgccagaaataatttgcttttatttataggtataagaaaagactcacgtttctcacgtttataattcttttctgttggtcgaacacatacaagtacatctaaaaaattctttttaatatatgaataatcaaccttttcttttccttttaaaggatctaaaagtatatatttcccatattttttctccgcaactacaacataatgattttcttttgaacacatgataatcggtaaacattttatcaaattttcttcggtttcgtagtttccatacgccttgaatgaaaaattatgttcttccgtaatttctttcatttttgctaaagacataccatttcttccaatacttgttgtagcttttaattcactaatatctatcttatatttataatattggaagatcattgtcaatgctgctataccacagtctgttgtccccatctggcgaatcaatggcacactttttttgtgcataaatacacctccctagtataataaattagtattggaaataataaattctattatttccaatactatcattttagacttccagagcaattacacaaggtaaatctttttttatatctcgcagcaaagaatatcccatgccacatagtcctgtcataaatccttgcaatttatatccatatagatacgcattatcgcaatcaaatacaccattacatacattctcagcaataatatcacgaatatctacataatatttttctatctttttatctgaatggtcttttaaatattcaaataaaatttctgtattacctaaattaccatgacatagacaattgtttcctaaaattccctcttttaatattgtattcactgctacttttatatcattttctatcaaatccgaataccgcccattcaatatgacatttactttagatcggctaagcaatatgcctgcagcgccatgacaccaagcaacggtaaaacttcctccatcagatgctttttctcctgcatataccctttcgtctttccaatttcctttttctttcacaaataaagaattttcaaatttaatgccatcgagcagtgataataaatactcctctttctgagtcacctgccatagttttgccagtgctaaaactattccagatgctccatgtgaaaatcccgctaacggcgaagttcttccatctccattccatccgcctttaatagagccttccttttcctgagcatttactattatatctcctgctatttctgccgaagcgatatactctttatttccagttagctgatacatattgatcaatgtaataactgcgcctgcattaccatagacaagatcaaaactgttatctctggtaatcgctttctttaatattttatagtgcttttttgcataatccaaatatttttctttatttgtaattttatacagtacctcataagtgtacattatagacgcttctccaccaaaggcgccactgctttcattttctattccctcatttcgttcacacatctcatctgtgtatgtaaataattccttttcaatcgcattgcgtataataaggtactccttttggggatcaacagcatacaatgcgttaaagaaaattgctagcccagacattccttcatataaataggtaccaagtggtcttatatcccatgagcagtcatcttcatttcctattagagtaacaccaatccaattaacttctgttctatctttattaaaaacagcagtttttataagagaatcagccaatttctgaacagcttttaacagatgagccttatttttttctctgtgcggaatcattttcatttgttgaagctctatctttttatcctcaacctgaaattcgtttatctctgtcagaataatattcatgaacattaattgcctttttaaatcatcttcatctaacaatactatctttttctttaagtgttccaaactggtatattcaaaatagtcttcgattttctcaccttctgatccgaaaagagatttacctgatgtattgagataaaaatatggaatgtccatgtttaacatgtcttttatctcacatttcacaacacctttatctccttgtgtagcttcatactgtttaaataaactacacaaaaacatttgtctatctcttccatcttgcataaaatccggatgaaaagatgtgtgtaataacatagaatatctttgggtatcctgaactaaatggcgaatatttaaattaccaaacatgtcggcatattcaagaaacttttctttattctccaaaacatatttatacgcatcttcaaatcctgcatttatttcttttagataatgaaatgctgatacattttctccatctaatttaacaagattttgatttactccagttgtaggatgttcatatacaaatctcatatttgaagtacataaatccgctattttaggaataactataggatattcctttccctcactacctttaattgcactcatatctacgccttggcccaaatttgaaaacctatagtgtggcaataaacctgagtataatactgactcatgaaggatataatttatttcctcctttgcagaatttgttctccctcttctacggttatctagtatagtttctgcatctataataattggatattctcctgcggcaatcacattttcttcatgtaaatcatttgtattaagaatataactaccgaaaatcaatattccaaatctataaaaataccgtctgatttcatcctctgttttacaacttttataatatacaaattcctcccaaccatactcctgacaatctaatatttttggttcatacatctcatatttacaaccagcatttatctttcccagaaaatcgaaatacactttttcaatttttaacgaacgtggtttatacacaattttagtgccattatccaacttaagaatacttaccccattcccttttttatgagaatccgagatattagaacttatttcaactacatttttaaattctaaacctccacaaaatttattcgcaatttcatttttatctttattaagtctttctaataaaagtacataataagaagataagttttctacggtttctgtaactgaacgtagtaaacatggatatatattgaaaagctcctgtttatacgatttcttacttaaaaaattattattataataatcgtattcttcctctgaatttcttccattcagttttcccgtcttcttacaaagatacatttcaaacattaatattccaagactgatcttccctaatctctctaataaggtatttgcgtatgtatctataatagaatccgtccaaaaaagacttgttccattttttaatatgtctattccgtaattgattaaaggtataaaaaaattatcaaatgccaatttttctcctttgaatccggaatagttataattgattggtttttcaaataattctatttttaccttttccatttctgacatcacgtgattgttttcacatacataattttcagaatttaaaacttttactaaatcaataccataacatttctcagcaactcttaatgtatcttctcctaaaatctttttccaatattcaaatatatcttttttattttctgcttctgatgttgtataacttctttctgtaaaatatgatgctctctcagtattcatgttcttaaacaccccattctgctttccatttcaactcacaattcgtatctgtactgcacaaacttcaattaacgcttaccctctttatcaacacctgtgtttatttcttagggcagcaaggtttcagcaaagtaccaaaatagcattctgctgtacttgtacataaaactccgccggaatttctggtttcaccagctcctgctacaaatttgtttaaatctgcttcctgcagctccatcataacgttaccagccggattgctaaagttttcttctcttgtaataggatttctcatttcactcataattatttctcctttcataaatcaattttgtacagtacagatactaattctaaattgaaatggttgaattattttcttctgttccttacattttagataatacaccttttatttcttgaaattttattcatgtaataaaatcgactgtctatgtaatttttgttagaatattaatagttttattttttcacatcttccatataaaaatattactgtctaccaacgtaaccgttcaaaacaaaaatcttttctacaatgtcaaaagcggatatgcgctaaatcgcatatccgctccaaattctttcaaaccgcaaataatatttccctatatattctctgcaactctcataatattcaattatcccaccatatttttcgatatttgctaggtgtcctcccatacttctgctgaaacgcctggttaaacgtcctttggctttcaaatccgaattcaagataaatatccataatccttttatctgtattttccagcagattggaataataatgatgtaatattcatcaccaaaaatgattatcaaatttcaacaaaaagatgtaaataatatcaaatacaccgtctaccttttacctcaatttttttaatcaatcttatttccgcttaccaacattttctttttttaaaattttagaagtttttacaagtgcttctattaaagttaaacctgtcagaattacagcaactcccatcataaataatgtccatgctttgcccttatcaaaggttaccaaaatagctatcgcagctacaggcatgtttatatatcctaaacttgttgcccattgaataaaaaagttcggccaaaactttttctcttcttccacttcattcactgttttcacttttttggcgaaataaagcatacagactatagatacagctatcagtattattttccatacacaattaactttcgtttcctctggtggaaaaaaggtatctatcatgataactgctattccaatgataaatgctatttcactatacaatcctgaataagcggaatctttcatgtcatttacttttttctctaaagcagtaattacagattggtgatactgttttgcacttttcttatttccgttcatgtaataaatcctccattaataataacatactatttcatctcaattatatctcccaaaaactataactttttcaaccgatacctcacattgaccaacgtttcgataatatcatgccccatcttttttcttatcttccatatcacatattctactgttctgtatggtatctgatcatcatgataatgaataccccatacagaatgataaatatttgtctttggcattacccagtttggctttaaagccagtagatataaaacttcaaattccctgggtgtcaggtctatctcctttccttcgtagataacctgataggacattggatttaactgtaatttcccgttgcccaacactacattctctttatattctggaaaaacatacttcatgtgtatgcctcctcttgatttgtaaattcaacttttctcattccagaaagaaatactggacgaaaaatccccgtccagcacttcttcaattatcagttattttaatgcactctctatatcctccgctgctttctataatttgaagatactcctggagcttttcagattggatattttccttttctgtaagtgaattgaattagaaagcaacttgtttttatgcagcttagcggatttcggatattgctctgcagttccgcccgcatagtacgataatcattttctatatccagtgtccttgttactgccctctcacaaatatccagcagttgcttgatacactctgctaattcctgcactgaatcattcaaataccgtcagcctgcaaaaggctgacggcaaaaaagatatcatatcactataaactatttttaaataaattttaatctggccaatccaaataagaagactcaaccaagctactaccactggctttaaaagtatctaaaaatgtacaatcttttgatatattcaaaccttcccataaataattaatagtacctttcatgtgaatttgtacaaattgtttattgcttgatatatccgtccaagaataattaggttcccaactgccgagtgtaaaacctgtatcataggaactgcctactagtgaaacgcttgaaatccgagaagaacttacattagctgtaaaatcttgtttaatatacccccaaccgattgcaggaatcatactttctacgcttgcagtataagatcctgttgcccttgccatattagagcgctctataagtttcacctccatattctgcatagcattcttcatcattttaacatatgattttactgatttttctatttcttccacgctcatatcgctcctgctaggtgagatataaacattttcaaaaacaaccccaactccatttgcttctgcccaagtattaagttcttgctcaatatatttgtttggctcaaactgattttcatcatttgaagcatatactggaatagtcactaaaaacattgtacataatatcataataataccaattactttttttatattcttattcttcatttttatacctcctgtatattttgcggtagcattttaaaaacaatatataaaacgtatatataattataatatttaaaagaaaattgcctattgaaaaatgaatagatataatttgttgagtatttatatggatagaataaaatttatatggaaaacctaacaataataaatttttctctatcttttgggttaatggaatatatggaatacacattacgatccctattacaataaacaattccttaatcttaaaatattctttcaaagctttcgcctccctcatacttttagtctatataatcaattagaacatcggaatcaccttcttttctaaaataattactgcatccaaattcaatttatatttttatctcatcatttatctgatttaacaacagtcttctatatatatcattattattaaataattcttcatgtgttccgcttccacatattcttcccttttgtaatacaacaattttatctgcacattttattgtcgaaaatctgtgagctgcaactatagttattctccccaacatcaatcgttctaatgctcgttgaacagatttttcagtacaactatctaaatttgcggttgcctcatctagtagcaatatttctgggtttctaatcatcgcacgtgctatagcaattctttgtttttgtcctcccgacagtttaacaccttgttcaccaacgtctgtattatacccctttggcaatgaactaataaatctattcaactctgccttttctaaagcacttaatacatttttttcattatagctatcaagcccataagttaaattatctaaaatagttcctgccataattggtgattcctgttgaacgtatgctatttttcctctccaatcattcataggtatattcctaacatctattccttcataataaatattccctttgtcttgttcataaaatctctctatcagtgaaaaaatagtagattttccagatccgctttctccaacaattgctaaagtctctcctttttcaatgaaaaaactgatactgcaaagagtattctttctatctgaataccgaaaagaaatattatctaatactaatccacaattgcatttttgatcggaaattataatctcttttttaatctttttctccacgatttcttcatttaaaattttactaattctttccatcgcaccacagcttctattcaattgacctacaaatgccgtcaatcccatacaaggtgttgcaatttggaaaagataatatataattgcaacaaggcttcccgccgataaactcccatttgatactctcacacttccatatccaaatataagaattagtaaaaggaagatcaacattgttgttaaaggttgaactaaagcagttatctttccacctttaatacctatattaaataactctttcgttaataattttcctctttcttcttctttttcttcagctatacatgttttcactaaccgaatattagttaaaacattgttcattctcgcctgatattctcctgtcttattttgaaaatctcttgaaatcctatataattttttatttaaaggactaattgcaaaaactgttattggaactaatccaaccataattgctgccattttccaatcaactgcaaaaattaaaattatagagcctattatagatatagcacctgtaattgcactcaaaaaatcattcgttataaactcactaattaccatagtatcgtttgttatcctgctcattatttcgcctgtttctgttctatcgaaatattcaattggtaaatgcaaaactttactccataaatcatcacgcaattgcataataattttatgagccatccaagacatcaaatacaacactcctaccgaaaatattacttgtagcaaaataataaaagcaatccaacaaatttttttccactcataataatttccactactaatatctatagtattcattactgctataggcatatataatgtacaaaaaacttgactaaatattaaaaatagcaatatacctatgttttttttaagtggcaggtattttcttaacaattcccaaaactttttaacattcaattcgtttttcatctatcttattcccttttcctataaaccagaatatcagaaaaataaatacaaagataaagatatagtccattaaattactatttccttttataatcaaatattctccatctaatacatttcttgtatttgctataatagtttcatacatatcattcttagatcgtaaaacgacatcaactactccaaataccagcgttgcaataagcgaaaatatcatacttgaaatgtataaactattcccacgtaatttacttactttcttacttttaattaaatataaatatacggctgctgttagtaatcctggtacaaacagtactccatatagtgtaaaaatgttcattgatgaatatccccaaaatactgctatgctccctaatactcctaatgcaatttctaaaatccataaaataatatttttcctcatcttttctacctctctttacaaatatatgcaccacaaattatacataaagtgtaccaccataggcgggtataatttttttgtatatatccttaatacagcaagtattatgcctgctggaaatctatacactaaattacttaagaaatctcctcccgtatgtagtgcaaacccaaaaattatagcactgacaataaccacataatattttttacgaaacaactgtgataataagtaaaaaataattcctctcattaaaatttcttcagatatactaacaaatagttgttgacttacaacttcagtaaaaatcttcaagtttccttttgttataaataagaaaacactaaaaatcacagcgctaattaaaaaaatactatctgttataccaatttttgctattcctatttctgagattttaatattatgttgcttttttagtacataaaatggcataatcacaaaactgataacgagtgacaaaatacttgccagctcctccatatttccttgaaaagccaaatttaagaataaaaagcaaaacatacataaaaagttactcagaacaataatacaaactatttctataagtaatttttcttttttatccataacttatatctcctaataagaaaaaggggaagtttaacctccccctcctcttgctgtcataattcttaccagccctttttatttccgtatcctgcacataatcctaatacaggaccaaaagaccagcaacctgcatttgctttcccactcttaaagatcatacttacgtcctcctttctcagaaatttatataattataaaaactatatacttgtatattgtgcaaaaagattatcataaaatcgttttgctgctaagcaataaggatctctttttttcatatcgcctgtaaatagatatgctcgtcccctacatgctccaccacataaatttttgtattcacaaattccacactcttctatatcatctaataatatattatttccttcaaaatcagactcatcaataatatcctttaacctgccatgttttatatttcccattttacattcttggcaatgtagcatatggcacggataaatgtctccgttatatgctatactaatcgttttctttccaaagccacaaccttcccgatatgtaatgccaaccacatctgtaggtgtatctaaaattgtagttccattttctgactctgtaatgttatcaccgacaataacaaaatcatcctcgctgaatttataatcttcaaaaatcttttcgctaaaatccactgtaaatatactgaaactcataaatacacccaatttttttgctaaattttcatattctttcatgaatggaacattcttcttatgtaatgttacaatcaatttaatcggtatcttttcttttagtctttctaccgtatctaacacacgtttcataatacctttatctcttataaatgatgttttgtcatcatatccatcaattgatatgttaagtgcatcaatatacggcaaaaccacttcataatcagagatgttcatcgttccatttgatataacttctaagcttccatttactgtttctttaatatatttacaaatttctcgtaagtcttttctcagaaatggttctccacctgaaattacaatatttttcactccaagtaatgataaatcatcaatgacacatttccattcatcaaaacttaattcatttcttgtattccgattttctacataagaatagcatccaagacaatgtaaattacacgcagaattgacatgtaaatatactgagtcaataccttttatttccttgtatataaatgtcaacattaaaatgtacatttttgatcatttaagaatgtacatttttgctattcttcctcttgatcggtatatttttttaagcgataagattttcctgtgatatttaccacatgtgcatgatgtaacactcggtcaagaatcgcatttgcgatcactggatcaaaaaatacatcatcccatgaattaaagttgatatttgtggtaatgatcgtacttcttttttcatatcgcttgtcaatcagttggaaaaacagctttgcatcatcttttttaatcggaagataaccaagctcatcaatgatcagcagcttatatttgaaaaagtgttttaatcttgcttctagacgattctccagttttgctttttttagctgcatgatcagatcatggcatttgataaaatatgtactgtaacgtttttttgctgcagttactccaatcgcagtggcaagatgtgtcttacctactccgctcggacctaaaaacacgatgttttcagcattttccagaaatcttaaagttgcaaaatccttgatctcttccggattgacggatggctgaaattcaaaatcaaagtcactgattcctttttgatgagggaaagctccgacttttaccatggaacggatcatgtttgcttctttaaaatcaatctcataattcgttagtttacagagtccttccgtaaatgataatggtgacgaagtgatcagatcaatcacttcatcaagatgaagatccatctgattcaatttcagatactcaaggtttttctttaattgtacatatgtgctattcatttttaaacattgctcctatctgtgtcaggttttcttttgcgatcttttcaatatccattgtctgctctttgaatgtctgtttactgatagcaacataatgatcgtgtgtataattaagtttttttgcactgatcggatgtatcacgatcagttctgtgttataatacacatacagataattatcatatacctgtaataccagacgttttccaagatattttggtggtacggaatattgattggaacgataagtgatcatacaggatgaattcacttttacagttgtatgggtcatctgataaggctttcttatcacattgcgtggaagtggtgataagtgagccttttctttttgaagatacatcacagggatccttccggttcctgggtgcaccgcatgattgatccgttcattcagtttatggaccagttgattgagctcatgataatcgagaagtccgttataagcatagatttcatcgagcagtttcatcggagcttctacttttgcttttgtctgaggccgtgcagcaatacagggtcgtaccttaaatccataatctgaagcaaactgggcaaagcgtggattcacttttcctttactgtaagcagtccgtggctgatccatgaccgtcttcatgttatctgtcagaagttcttcaggaactccaccgaatgtttcaaaggcatcatcgataaaggaacataagatatcctgtgttttcgataatgataatctgtaaacacgaaaccgagatgatgacagcagcaatacaaagatgttgatatcgatccattcaccggattttaacagaaactttatggattctttccagtccagctgtgcctgtttcccaagaggagtttcaaaacgcagatgagatttctttttgatatgtcgtttctgccttcgttcaaaataagactggaattccgaatgctggctgatgtatctgcggaaacttgactgggcacaggaaagcccatgattatcttttaagaattgccataaaacacgtttataatagaaaatctgctggttttcatcggaaagaagatctttgatgatatcataataatcatcaatgcaagatgaacgcctgcgggctgttggtttttcatatccttttagatatttatcaaccgtccgtcgatcttttcccagctctctggcaatctgacttttattaattttcaatgtactgtcctccaaaaaaggggttagttttaccagatcccttaaagaattgatctgaatgtcactagtaatctttggtgtatatatcataataaattcctccgtagagaatttattataatgtgattttgtacatttttaaatgatcatttctgtacattcttatattagcatttatacttgtaacagcttttcaaaaaatcattttcttccaagaccttataaagttctttctggttatcagatagtgaagaaatctctataagattgctctttaataaatctacgacttcttccccttccctgtctaatccaattaccattccattatttcgatttgctataatagttattcctttgactttgaatgtctttacattattacccaaccagtccatatcttcctccaaattaaatatctttgtttctaaattctctaattccaaaataagtggtaaaaactgctataatagaaaaataaattgctcctattaaaacctgcgtccatactactttttccatcattgtaaaagtattgatataatacaatggggaaaaatatttaaacactttcgtataagaaagtaaattcatcccaatgtagcctatcatataaatccccaagcagactactaatctatactttatggataacatcataatgataaaaattgttattacccaaaaaagatatatggtaataatctgtataatttctattgaaattctttcatcatacaacgctccatttacaattggagttttatcattcattataaaataataacaaaacaatcctacaactactaataatacactaatcacaccagcatacacgcttaatgcctttactttttctatatagattttttttctatcacctactttattcaaataaatccgtaaacttttatcttcaatttcagtccctaatgttctacttgtaatggcaactaaaataatattaaaaataaacatggattgagccatttgaaacatcgccgatataaaattgattgctgtaatatttccatttccgctataagaaactatttctgaaccacttgcaattcctacactatataaaatcggaactaaaatcactgttaaaaaaatccatgtatcttttcttttatacaatttatataattctgttttgtaaactacctgctttctatttatcatatcgtttcctccgccaaaaataattttttcaaattattattttgaattgacattcccacgatataatgcccctcttgtaataatattctttgaatatcaacaatatttttttcatttttaaaaaaaatacaatctttttcacaaagtatagtgggatcttgtaactccaacttttttttctcttctgtgcttatatttccatcaatttttaaaataaaagtcttttctctcactaatttctgatccaaaaccttttttccttttcgaaccatcacaactctgtcacatacttcttccacatcatctaaatcatgactcgaaaataaaacggggattttttcttgatgcgccttatctaaaattacctttttaaataattcctttccaaccggatctaatcctacaaatggttcatcaaatatcaataattccacatctgttaacaggctttgacacaatcccaatctctgtttcatgccaaaagagaatgttttcactttcttttttttgctatcagaaagttctgtcttctgcaatagactttctattaaagtactatttttcttgtcttctgataatattgatagatactgtaaattctcttcggctgtcaaataatccaaaaaactaggctcgattaaaactcctattttatctaatgttttttccttttcactagatattcctttaaaagatatacttccagaagtaggtctaatgaagccacaaatagaatttaataatgttgtctttcctgcaccattttcacctataagtgccactatctctcctggcattattttcatggaaaaatcatccaatgctattttgtttttatatttttttgtcaaattatcaatcgaaagtgcctcattcattatgaccaccgtctttctttgttttgatggtattactatatcatgtttttttaaaattcatcttatctgaaacttaaaataacataaaaagcagggcacaatgccctgctttcagactgtagacaaagccctgcttttgcagagttttgttattgttggagccgcttttctgatataataaatatcagaagggcggtgttttttatgatgacgaaaaatgcagataaaaaaagagaacaaatgatgatgttttccatggatgacatggtacctcaaaaccatatgctgcgattgattgataaagcaatcaattggaactttatttatgatctggttgaagaaaaatactgtccggataacggtcgtcccagtatggatcccgtcatgctgataaagataccattcattcagtatctctatgggataaaaagcatgcgtcagaccatgaaagagatcgaggtaaacgttgcataccgctggtttctcggactagacatgttagatccagtacctcatttctctacatttggaaagaattatacccgccgtttcaaagatacagacctttttgagcagatcttttcaaagattctggaagattgtatgaaatataagcttgtaaatacagaacagatcttcgtggatgcaacacatgtaaaagcctgtgcaaacagtaaaaaaatgcgtaagcgggttgcacacgaacaggctctctggtatgaagaggaattaaataaagagattgaaaaagatcgtctggcacatggaaaaaagccattaaagaaaaaagatgataaccagccacctgcatccggtggaaccggaaatgataaggatcctatatctgaagaacttcctgaagatgtgaaaacacaaaaatgtagcatcagcgatccggaaagtggatggtttcgaaagggtgaacataaacacgtttttgcatatgcagtagaaactgcctgtgataaacatggctggatccttggatatacagtacatcctggtaatgagcatgacagtcgtacttttaaagcattatacgataaaatatctaaactgaatccgcagatggtagttgcagatgcagggtataaaactccggcaatcgcccgtcggctgttggaagatggaattcaaccactttttccgtatacccgtcccaagaccaaagaaggctttttcggaaaatatgacttcgcatatgatgaatactataattgttatatatgtccggaagcacatatattgacatacagtacaacaaacagaaatggatataaagagtataaaagctgcggtgagcattgtgctgaatgtcaatatctttcaaaatgcacagaaagcaaagatcatgtaaaactgatcacacgtcatgtatgggaagaatacatggaagtggcagaagacattcggcacacgatcggaaacagacagatctaccagttaagaaaagaaaccatagaacgaatcttcggtacagcgaaagaacagcatggatttcgatatacgcagtatgtaggaaaagcacggatggaaatgaaagccgggcttacctttgcatgcatgaatttgaaaaaactggcaaagatcctggaaaaacgaggttggaacacagccagatttttgttgattttgaagaaaataaaaagaaaagaagttttaaaagaaaaatggtgctgggcataatccccaacaccaagtttgtctacagtctgaaagcagggcacaatgccctgctttttatgttattttactggcatcacaattataaatgcctttgtatatttcttatatggctgctcaaaataaatagctgcttcatgtgcatccagaactttttttacaattgcaagtcctaatccactattactactatcatttctcgattgatctcctttaacaaatggttcatacatacacgaactaatatcttttggaatttttttcccatcatccgctataacaagatatatttttctatcatattctgtcagtctaatttcaatagtcgtatcttcatcattatgttgtactgcattattcagtaaatttataattgctcgacgcatttctcttttatcaatgaagatatttctttcctcctcatcaacctccactctcaaaatgtttttatttacctcaatataatggtattgatctgccaaaatatttttcacaaactcagtaaaatccactaattctttgtttaatttgtaatcgactcgaaacatcctattataatcgcttaattgctgaagtaactgctccatttcaacactgctttcaaaacaacgcttcaaatattctatgttcttacttttgctattttctaaatcatttataacagttagtaaatatccttgaacaactgttaaaggtgttcttatatcatgactaatatccgagatcaattgtctcctcaaccgttcttcttcttctttttgttttacagcatcttccatttcttgcgccatacaattaaaagaatttgccatctccacaaattcatactctgctttaaaagatagtctttttttataattcccacttcctaattctttcattgcttcttttaataaattgattggcttggtcaattctacctttattttcttagacacacaaaaaacggttaaacaatacccaattccaaataaaataatacctactatataaatccctaaaaagtgaattgattctgcctctaaaggaatgtttatggttggcgttactcgcaagaaatctatcggaaaaaaagttacctgtattcgctgtctgttctgttcatcataaaactttttaacaatccctctatatttttttccatcaatttcataattaccatttacaatatctataatttctatgctagtgtattttttatattctgctctcggatattgtctttcgtaatctgtattcaatatttcaaaccatgcaccatttctttttaactctgaaatatctatatcttcatatcggctttttccctcacaactgacaatatacttttcctctaatgtattaacaatttttgagttattaaatacacttattacactcgccacgattgcaaatataataacaatcactattgaaaaaaaacaaaagttttttataagcgttacttctagtttcttctttctattttccaaatttatatcctaacccccttactgtaataataaactgaggatttttagaatcttcttctatatagtcccttaatttactaatataaaccattattgtattactatcatataaatactcgtcttcccatacagcttcaaaaatagcctttttagtaaaaacccgttttggattattcatcagtaatttcaaaagtttatattccttatttgtcaaacatattttttcttcatctttatataagcaacattctttacagtccaattttagattctgaaaacagataacttcttcttgaatttcctctgcactaccaaattcataaaatcttctaagttgagcatcgacccttgctaccaactctaatggattaaatggttttgctaaataatcatcagcacctttttgcaatccaataatcttatcttcatctgtacttttagctgatacaataataataggaatattctttttttctcttattgctttcatacactcataaccatttactaatggcaacataatatctaaaataagcaaatcaattttttcttttttagcaatttttattgcattaatgccatcttctgctttaattaaattatatttatcttctaaatgtaaaaccatcaaatctaaaatttctttagaatcttctacaattaaaatagtaaacatatttcacctccattttgtcgcataacagtttttgtacttgaaatgaacttttcttcttttcatatttctataatattgaatttgtttgatataactattatattccatatttacgccaacttcaattcttacaaacaattttatatattcattagccaattaccattttagcacttcatgataattttctcccacaaatatcacttatcaaacaaaatatagtaaatcacatttttcgtagtaaactaatatttgaaatttcaaagcttttacataaaaaatgccgctacaggtttttatcatcacccgtaacggcattttctcttatcttattcagccttttcttcattaccagattttaaatacttcattacctcttccacagtttttccggaagcaatcaatgcgctaaatatctcatctttctgtttatcttcgattttcttcctgaggtcctttgctttcagacgcagttcttttaattctgcctctgttgttttaatctcctgttctacagttactagctgctcctccagagatatattctccatttttttgcgtcttggcatatctgctcctcctaatacgatattttctttattgtatcactctttatcggaaaacaccatatatttttctggacttttcttacctcccgtttcttcgctgctgtttctggcttttggcatattccatctttttattgtattcgtccatgattgcactttccagatctgccttaaattctgcattaactgcatgggcaatgtcctcccgttctccttttgcagaatttttctggggcatacctacaaaggtttttccgttccatgcctggatcacatgaagctgctggattgccaatacgtcctgcagacgaatggcaacatctgccttaaaggtatcgcttccctgtaccggatttacactcagattgtaatacagttcttcctctccccaactgcccttacagtctgttttagtttctgtcatattctcataggcttcccttacagtatccaacacttccttttgaaattccttatcggtaaaccgaaaaaaaggaacatactcccctgtttcgtaatctctgtaacggggcatatcgaggtacagatttcctttcgaggactctttaattgcaagacttttcacacagaaggcctcatcaaaggtaatggtagcaaatcctttcagattattgatctttccttcttcctgtttcaattccggtttatatactctgatattatattccatattgtgatctccttttctactctacttttctttaccgaaccgctgtctggcatggaagatttttggtttcctcctgcacttccacacactcctcctggtccttgatttccagttctgcatcaatctccatctgccgggtaatgttttcttttaaaagctcctcatacgggaaaggctttgcatattcctgctttgcattttttatctcattttcacaggtcttaatttctttttgaacatcttctactgctttatcaagggcattcaagcggttttccatacggaccatattgccggagtcactgctttttaactccacactatattccttctctccctgaaggaacaataccggctccatcatatccttttggacaaatacctgaaatcccttatacataccgacttcgtgcctggtaaaagctgtcacaccttctataatcccacgcaggacttcccctgcttctttatgcttctcatagacttttccctgcagcgtgattgcaaaccccggctgtacttccatagcctggttcctacggtccaaatccatttgaagcgattgcagttctttctccagactttgtatccttttcgggtactggaacgtaaccgcatcctgcaaagcaaaccgtttcccttcatgtgcagcttttaaaattctcagacgtgccacttcattatctacttgtattttttccataatcaggggattttcagaagctaccgctttaatctctgcaaagtttagtacggtttcatctatatcctcacagatccttgccagttcccggctggtaaatacctggctgataaaccgctgttttgtttctacaatgccccataaataagcatcaaaagaaccctttgttacatagcggtaaatattgacttcctcattttcattcccctggcggataatacgcccttcccgctgttcaatatcagagggtttccaggggcagtcgatatgatgtgccgccaccattctggtctggatattggttcctactcccagtttttcggtacttcctataataatccgtttccttccggctctgacatcggaaaacatacggtccctctgttcatctgtttttgcatcatggataaaacagatttcttcctctggaacacctctggtaatcagttcctgttttaaataatcatagacggtaaacgctttcccaggtccgggtgtcccaatatccgaaaaaacaatctgggttcctttctgttcctgggactgtacatattcctggtaaatgttttctactgctttattcagtttggaatccgaatctaccggagcataactgtccaaaagccggggatctgtacccaaaagccttgcttccccggtaatccggagcatattgtcgtcctttggatctaccacacctctatggattgcttctgccctttccaccatttcctgcatacgttctttgacataatcagaggcttccgatactacaaccttatattttccgtcctttaattctggccgcttaatatctagcatatcaggcagaataatgtctgctatttctttaaacaggtgtatcagttccggcagattgataaacttattaaacctggtccgcatccggtaaccagtaccttccggtgccagttccaaagagctggtaacttccccaaacacagaagcccatgcatcaaaatggtaaatccccttttcgtgaagccgcctttcctgcagatataactgcatcacataaagttccaccattgagtttgacagaggggttcccgttgccataatgacgccccttccctgatttttttcgttgatatactggattttcatacgcatatccatagccctctgggaaccgctggaacccagacccgcaacattgttcattttcgtaaaaatttccaagttcttgaacaggtgcgcttcgtctacaaataaggcatctacgcctgtttcttcaaagtacatcacatcatctttgatttcttcattgttcagttcttcgattttctgcaacagttttttctttctgctttccatctgctttatggaccagttctttcctgcttcttcccttgcctggttaatggcttctaccagttgctctgcctgttcttctatcatggctctttgccggtcaggggaaatggcaattctctggaactgcgtatgtccgataataatacagtcataatcccctgttgccattctggcaatcatgcgcctgcggttttccttctgaaaatcttcttttctggtaatcaggatcttcgcatctgggtaggcccgcaaaaattctgcccccatctggaaggtcaggtggttgggaaccgtaagaaggggtttcgttgccagccccagcctcctcatctccatacagatacagatcatttccagagatttaccagtgcctaccgtatgggcaagcaaggtgttccctccacacagcaatgcccttgctacagcatttttctgataaggacgcagttttaacaaagggttcagtcccggcagttttaaataagagccatcatagcttcgttgtctgtcgcagttaaaggtttcattgtaaaaatccacatatttttttctgcgctctggttccttaaaaatccagtcccggaaggcttcttttatctgctccgccttatccctggcaagcatggtttccttccgattaatcacataacgcaccttttccccttcctgcacccggtcccgtatggtcacaatccggctgtttaacagttcctctataatgctgatcgcatccataaatcttgtgccataggtttccctggtacgaatggttcctccaaaaaaatttcccctgtcaatatggtaagacatatctgcatctaagcgctcaatcttgagggcatggccactatgagcgcaatagtttctctggttgctctccgggatttccaaaagctcatatataaactgttcgtaatcctcattttcaatccaggttgttcccagttttacactgatctcaggcgctgtcagttcttttggctgtaccttttccagtgcttccacgttgtctacaaacaagggattgttctgcgcataaatcctagcagtacggagcttctgccgcacatttccgcttaaatactcatctgcggtttcccaccctgcattgggatcttcttcttttgccagtaccgggttctggtagattaacccttttaattcctggagcatttctttcctgtttcccagataaagagagagcatatagggaatatccacccggttatattctgacagactgatatgcaatgcttcctgggcattttccactttgtctatcacatctctggggcgtatggtccttttgtaaaaaatatcggctttggttacgtttttgtcctcatcaaccacttccagggaagatagcagggggtaatcattgtcctgccggaacgccattttatttgtccggtcacagaaatatccatgcgttttcacaaaggcatcatacaaacggtttaactgttcctgtgcctttttcagttcctggtcagaacaattttcctgctgtatctgtaaaatttcacgcaccagaaggcggattttatgcatggcacgtatccggcgcttcacactttcctttgcctgactccggtataaagactccccttcccggtaatatacttcgtcctgtatcaccgtaaacgtataattaggtatctttggggaagcagctaagacgtcctgctcttccttctttttttctgctatgctttcttcataacagtttttaggaagctctccaactgcgtccaaaattcttttttccaggtcaaagtcttccgcttcattgaccagggctgtatatttggaatctttcccgaaaaactgttcaaaccagaccattttcccaagcatcatttccgggtgttccagataatactcatttaccggtaccatgtcttccgtaagccctgtataagtccagattggctccccaatcgaaggctctgcttttttctgaaaaaacaaaaggtcactggtaactgcggtattggcgctctttccaaaagaatctgccggaagccggactgcccctaaaaggtctgcctgttctgccaaattttttctcacagcgctgtcatttttatccaacgtcccttttgaagttaccactgccaaaatgcctcctggccgaaggaggtccatgcttttccggataaaataatcatggactttcaacttcatctttttatatcggggatcatacaaacggaaatccccaaaaggcacgtttcctacaattacatcaaagctgttatcctcaaattccgttttttcaaatcctttaatctggatactggctgaagggtggagcttttgtgcaatccttccgcttatggcatcaatctccacgccataaagctgggatttttgcatactttccggaagaccatgaaaaaagtttccaatccccatagccggttccagaatttttcccttctggaatccaaactgctccagggctttataaacaccccgcacgacttccggcggcgtataaaaagaactgttgacactggcccttgcctgggcgtattcttctgcggtcaacagttccttcaattcctgatattcttttttccactccgggcgtttactgttaaaagcatttggcagcccgccccaccctacataccccgcaagaatttcctgttcttcttttgtggcatttctctcttcctgctccagtgtttttaagatacggattgcccggatatttttctgataccggcttttatccccaccggtaaactgcaaccacccttctgggtaataataatctccggcttcttccttgccttctgtctggacagaggttcttccttcctgccaaagctcttcctttttaagaatttcgctatattcttcccataatgccggaaaccagggaagcagacggtacatattctcctgctgctctaaggtttctgaatcttcggtataggcaatctggtcctcctctgccagatgtgcagtaagcccgccaaactgatcccaggaaagttcctgcagaaaatcttggctttccggcagggtgatcttaatcccattttcctgaatacaaagctcatagcttccatgttctgtccgcaccagataataaggctggccttccggtacttcccgaagcaaaagcatcttcaaaaaatggtctttttcttccggtagctgattggtcgtatagaccagacagagcattttctttaaaatatccgcctggatattctgtttataaaaggctatgccaatctcttctaatgtgattggttccttttcctcaatcacttcctgcactttctctggctgtaaggtttcttcctctgtttcttccccattttctaaggcttcctccgatacagataacaaaggaagataggtccctttttcaatccgtttcccaatttccaaagaaacttcgtcccagtaccagaacgcctccttcatggaagttccctcactccaaaggatataaaaaccactggaaccgctttctgcggtcaggataccgtcttttgtatgggcttctctttttacatctccatacaattcataaagataagcttcccggtctgtttcctctggattgttccggtaaaactcataaattttatatggtatctcctgctccgtcatttccagaagaattttctctttctgccagttttccggctgtgcaggttctatctccccagacagaaaaggaaccgccgaagcagttcctttctctgtatcctcttctgttttttcctgttttatccgatcctgagctgaatgatctcctccataacctgtttctgtgcttccatatccgcctgtatccgaaggttggtcatttccaacgtgttgtaagggtctatcctgtcctccctggtccaggtcttcagaaaactttctgccagtttctcgtggtattcctccgcttctgtctggattttcataagccgctccatcagtttcccggacaggagcatcatttcgtattgtgcctggtccgttctcttcatttcctgtgctgcgatcctgccgtaacggttcagggacgccagcatcttctcctcgctcatcacgccctctaagactggtatctgtacgccattcatttccctgtactggattcctgcgattccttccataatactgcctcctttcaaggtctatgttcttcatggtccttgcaatctgtaacacaatccgcccagataaatgggatactaaccgtcctgtccggtacagaacctcctcattctctgaaaaaccgcagataaaagaaaaatccagggtgtcatctcggataccgcagcggcttttcaccgcataacagacactgtttacaagaaactctgtaatctggttttcttttacctcctgtccctctccgataaggacagccagcttctgcaaggattttaaaatttcatcttcctcttctatcataaaccaaacatttgttcttgtaaaggcgtctaaagaatttttaaagttaaatgaatttttaaattctaccttgcaagagtaaattctatacctgtagaaattacttctgcatggatttttccttcttctttttataaaatactactgcagatgatcccctgcctgtgcagaaggaggataaaatgaatacaggaagaccaaaaggcaaccaaaaacatcttgacttatctgcacgtattataatcgaacagcatttaaataacggtgattcatttagaagtattgcaatagaattaagcaaggatccaagtaccatatccaaagaaatcagacgtcattccattatcagggaaagaagcgcagatgcatttgcccctattccctgtgcaaacaattatgatagttcaaagccgcggacaaatatatgcaatgtcatgcatatgtgcggtgataatgaatgccggcgcaaatgtgtcctctgcagaaaattcagatgcagcgatgtctgtaaattttataaaccaagagaatgtgaaaaattaaataaacctccttatgtgtgcaatggatgcagcaagagaacgaattgcatgatggacaaaaagatctattcttcaaaatacgcccaggactcctatgaagcccttaggactaccagcagagaagggatcaaccagacaccggaaagtatacagaaactggacaacctgttgtcaccgcttctcaaaaaaggacagtccattgcccacatctacgcatctcatgctgatgagatcgcctgttccagaagaaccatatactcttatatagaccgtggcatttttcaagccagaaacatagatctgcgccgtaaagtggtatacaagcagagaaaaagaaaaaccactaccagccttaaagacagaagttttcgaaaagaccggggctataaagaattcctggaatatatcgcagcgaacaaatctgtttatgtagtcgaaatggatactgttgaaggagcaaaaggtaccagtccctgctttctgactatgttctttcgaaactgtagccttatgcttatgtttcttttagaagaacagacccagaaagaagtaactaggatttttgatcatttaacagagttacttggaattgaactgtttcagaaacttttcgaagtaatacttacagacaacgggcatgaatttcaggaccggcagagtctggaatatagcaaaaatgatgaagtacgcacacgcatttattattgtgatcccaaccgttctgatcaaaaaggtgctcttgaaaagaatcatgaatatataaggtatgtcctgccaaaaggaacaagctttgaaaaaatgacagacaaaacaacgctgctgttattaaatcatatcaatagcgaaaaacgggacagcctcaatggacacagtccatatgaagtatcccgtctcctgctggataacagacttcataaagcattaggattagcagagataccagccgatgaagtcacattgataccagcattaataaaataataataacaatacaggcacaggcaagtttcattgcatagaatttagtctttccaacagacatgtggaatttagtcctgcacactatttccagatgtccttttatcatgcaaaaaactatgctgtttatgccgtataaaagcattatatactaaaaaaatcaagttgtatatctccgaaaatagaattaaatcccgcataaaatcaaggtatattagaatgtagaatttactttttcattcaagcaaagaatttttaaactttttttcctgttcgtagatttccgggaacagctcccttgccagcagtctgcggtttgtcccattcacctgccagttccagggccggattccctgtccctttacatcttgaatatcataaacatgggtaactccttccccgaaaattttggaaggaaatactgcaattcctttacttcctctggcaaccggcaaatccatttccagccaggcatcatatcctgcaagaacggacgcatctgggcgctgggcatataccatacaggtatttaagaagtccaactgatacaaacgccccatgcaggaaaggaaatttttccaggaatcctccgactctgaaatccagtgtatggtttcctcatacagttcccgtacttttgtgatatgcttcatctgctgttccttctttcttttacaggtaccagttcttttgcagaaatatcacgataggaaaaatcatctgcccccagcacgattttttctgcataataatctgcttctgcttttgcagttgcctccagttcattcctgccccggtatcttacttttttctccaggacttctgttatggtcacttcatattctttttcgtccatgcttctcctttcttactgcaagcggctgggtcttccatacagcccaatgttcgacggattgaacgggtcattcactactccacgtctgctgttggctgcatgtaccattctgccattaccaacataaattgccacatgggaaatattgcggaactgcccattctgctcataagagtaaaaaatcagatctcccggctccagttcgccttctgtaacttccaacccatgtgttaccataaattctccctgggtagaggcaatcgccggaagggaaatgcctacctcctgatacaaccgctgtaccagggaactgcaatcataatatccttcctcataccggtgttcctgactgtatttgcagcctaccttcgtcagtgccagatttgcaacgtcacttcctacgccaaaggaagggatctcatttcggaattcctcactcatgacttcccttaaaagttcttcttctttttcggtcagctttccaagtgcaatatagtcctcataattcaggttcttgacgtagcagcccttctttgttaccgtaatctcattttcgtccccatctgccagaaacgcttcaaaagtctgatgtccccaggcagacgcagttgcatgatctgcacagaaaacatcaaattgtaccccataccggtcaaatgctccggtatcttctacggtatattcaatcccgttcataatgatcctggttcccatagggacaaaggggttttgtgcatctactgcaatggtatggtccggttttggcatgacaccggaggctgtaggtcctcctgcccactgtccacaacagatactgcactggcaataaccgctggtgacaacatttcccaggctttcccctgcctttatggtagtggttatggtcgtgttttcaaaactgttcatttcatcaaagatttccttcagcttgtccttatgccgctgatccatatccacacctatatccccggttccatacttcaccatataaaccattaaagtatcatagtaattactcacataattcccgtttttctcatggagataggtaactgccccatcttccccattttgtccaagttttgtattaaagtccatgtagtaaccgcttaaaacttctcggacggtagggttctcctcagacggatttggcatgaacgcaccaagtggcgaacagtataagaggaaaaagataatcactacagggattgccaccacaagaagaatactgaacagcggagccaaaagcgccccggcaaactggaccaccttcagcataaacacagaggctttcatctttacaatatcttttgccacctgtgccaaactgtcctgctgcccatttccggtgagcttattgatcatatactggatttttctctgccggactgcctgttttttctgtttctccatctgtttctttttcactgcttttgtttgtctgtaaaactgcttattggtgatcttcccatctgcctgttttacctttaattcctgctctgcctttctataattccgatccttccacatcttttctgccggttttgttgctgtccccatgacataaagggaatcattgacttcctccccgccctctaactgggtcaatatagcagcctctccccggcgtaccccttttatggcagtctgcttcgccagggaagatttttttgtttccgccagctttgcagcctgttccctccgatactgttccttcgcctggaaaccagcagagggctgactgtttggtgctaccccctgtttcatctgatccggctgtaaggttcccggtacagatacggtgcttttggcctttccattttgttttctatcttctgctgctccccggattgctgcctctttcccggcttgctttttcttttccttttgtttttcaaacagcgcttctctgccctgctccggctgtttccctttttctgccccttcttttttctttctctgccctaaaagatcggccaccggcttagaggtaaaagcagctttcttttcctttgcagataaaataggatttttcttatgcaccgtcacctgggcttctttttttaatttcagctccggctctttttctttttttaccttaatctccaaagcagtccccctctccggggtttaattcttctgcctgataccagagcgcctgaaacagatacccctgttccttttctctgggtggtggaccgtactccttttccaattcctgaaaggcttccataaggtttccggaaaattcctggtaatcatcttctgtcaggatatatttttcactgaacagcacctgctccaattcccccacttctaccaaatggtctatgtcttccggggaaagtggcggtcccagtctgtcataagtcttttctttcaggtaggaaaactgataaagttccgtctgctgcggtaaaatcttctccttactgccatcaaagagcaaaaaaatagcttccgcttttaagaaaacggaaacctcagcttgctcaccatattttagtgcctgctccttagaaggaaactccagccagtccggaatacggatttccagcatccaggcttcatactgcagtccaaaagataattgatattttgcgataattcctcctcccttccactacaaatagtcataataaatctcattggtatcttcatgaaaggacaattcatactgtccggggataccaggatcttccatccaccaacggaaaaaagcatctacatctgaccataagcgggaattgcactgccttcctgcagctttccttaactccagcattttagcaaaagcccgccggtaagccctctcataggtcgggaagatgcggaactcccggtatctttgttttcctgccataggacagcctacacagccaacccggtgaaatcccatttcgtaaagagggttcatgggtattttctctgcctggatatactcccagacctgctggtcactccagtcaacaatgggattgcatacgtgtttgccccttgacaggcatgattcaaagagtcgcctggtatcatcattatcattatttaaaataatggcacgtttttttccatttgggacaaagttttcataaatccccctgtttttcctccgctttcggctttctgcccaccggacacctgtggtgataaaacgcccagccccaccattttcttttagaacctcacaacaataccggatagtcctggtaggagggatcattttcatggggatcaggctccacatagttatccgctgccctttatagtaaggtttattgatactacaagttataccggcctgttctgccttctgaaactgttccctcacataataaatagtctgtggggcatctgcagtagtcaggttgtgcatcagttcaaatggcacgccggaacgccgtaccagttccctgcatacggcgctgtcttttcctccactgtccgtcactaccaaaggaagcccataatgttgcagggacatctggctggcagtgcggatacgttctattgctgttttttctaaatccaatttttttcaggagggaagatatcttttacatggccaaaactccgcctcctttcctaattttatctgccgcccctttttggcggctcatatccatttgctgcatacgcttctacggtcataccgtatgactctgcttcctgtcgtatctcttccataacctgttctttgtatgatttatccggacaggcagttgcaaaatcccggatatccggcatacaaggcagctccttccctgtatttaatgcaatcctgctttcccggatataggcaagcatggcttcctgatatgcttttcgtgatgcgtccccctgcgtcagtaaagggactttcttttctatttcctgttcttccagaaccgctgtttccagtttttccaggttgcagaaatactgaagggtaggaagcatctcctccagtacccatctcatttgctgttgttcatgttcccattcttctgttgtcctggcggtctgtttcataagctgctgcccttcttctgtatggagataataatctgcaaatgcttttacatgatccagcagatttccttccccgtcaccaaaatcctggcgcccggtataagacatgacttccccctctgagagaaaacagatttcaaaatgtgttttgtaataacctgccatatctttctcttccactgcctgccgatccagctttccgaacaattctaccgcttgatttaatggcatggcttcttccaatggaatgtccgggtgttcactgatccgcacatacacaaagggtttcaagtccaccggcggaataagttttacctgttccagtgttgtctttagcttgtctgcctgttctttcaactctgatttctgctcaaatatcttgcttcccagccacctgctgtattcctcttttccgtcttgacataaggctttccatataatagcttccttatgttctgcttctttcggataaaaggtatggtaaaaatcagggtcaagatttttttccagttttatcatttcatctgcaaaaacagtagcctccaaggttttctctgttaaaagccctttggtatcaatgacttttgtttccggaagataagcactcagttccctggcagctataaaaacctctgggtattggttttgatcatagatatctctcaaaagatccacatccaactccccgttataaaccagggaaaattccaatggaataccatcttcttcctccacatgaagcccaattccttttcctgcattcaacctttcagaaggaatactctgatagatctttactgcctcttctgcactgtggatatcctccctgtattctccatagcggttaaattccatacattctgccacataatacgttgtcaaacgtccggtggcattctcgcccatctcacctttttccacgtagcaatacctcctttttatgcacaaaaaaagcactaccgtttttagcgataatgctctttgtgttacttcttattttctttttaaatgatacagccatgctcaatcagcttctgctgtctggtcgttaaaatagaatattcaaggctttccctgtcttgatgcaagtaaaaacaaacaggttcccttaatttgctctttttcggaacaagctcaaaggcaaattgcccactgtcaaaccgggcaccatcaaagtatccctgaatgaaccgttcttccgtattcccactatgtagcaattcatcaatcattactacaccgatatagtgtttttcccttagcgaagcctcaatctctgcaaggtaatcaaaaggaggctcgctagtcttcataaccacaagaatattttctttttcttcacttatcacaatcatatcaaagttattcatctaacttactcctttctcctaatttctaaatcacttcataatattcatcaataatcgccaatgctcttttaatcaaatcatgagcaccttttatatccagcatctttgtagtatcaattggtgctgtagggtcatcccaatgttctattggatggcgattgctgttataaaacgtataaatatttccaatatactttacctgctcaggctttgcatttccatatctctctggtttcagcttatattttacacctattttatcaaacatatcaaaatgattttctttgatgtactgcgcatttggtataataccacattctattaatgctatttttaattgtgcttctacaacacgaattgccggctgagccaaatatgttccatcaaacatatcatctgtgacctttaaattatacacagcctgatgaagagatctttccattttcttagacggtagcttatcataagcatttggcatataaaactgaaattcagagcgaacctcgtctttatctatgttaagattatatgtgtcattaaaaattttaggaatttcttctacttctattaattcagtaatatatccaataatagtagaaaataacacttctggtcttccttgcattactactttattatgcttttgataatgtgtcacaactactctatctttacttttgttacattttaaagaaactgcttttccatgagcaatctttttttcatctataattagattgtcttttccaatttcatcaacagcaagtgctataactgttgacaaatcttcatctgaaattccctcaactgtaaaccaaaaatcgcctcttttaactttaggaatcccattaccttctgttaaagcagctttggctaatttatctgcttcttcattataatgatctccagaatgagcttttaccttttgataagaaatttttagaatatctgatttactcttcataaaatttgcatatttctgagtaagtgtattctttgccttccattctccttgagcccacttttcaattccttcataatcataacgaagttctaagttatgataaccattcttaattgcccattgtactgcatacatagcaccaagcatttcaccagcaacatttctaattgctaaagagtccggttcatttccatttcctgattctctaatagtttctcctcttggtgtaagaataatacacccaaaagcatattttcctattttctcatcaaaactaccatctacatatacaactaactggtttgttgtgttctcttctatatctacttttttaatttcttgtatcctattctctaaatagtttttcgcttcctcttctgtttcaaaacctttatactctgctcccggatatccacttaccgactctttacactcattccatgaataaaacaaaccggtttgcttacccttttttacagcataaacttttttctttgccatgtatactccttcaagatttgggattatagcataatacaacctgttcgtcaagaattttatgtttacactttgacgatatttgtctatttgtctatttagctacttttattttctgtttcttattttattatacatgttctgtcaaaaccagtcaatgtatttcactgttgcaataattaatgtaccttctctttctcactctttacataaggaagagattgctctgctgctacttcttccatttgaaagtattctggtagtatgttttcttccctgaaactaaaataccggttctcagccaccacgatatgatccaacacctcaatccccataagattgccggcttctgccaatcgctttgtcacttctatatcatgcctgcttggttctggatcaccggaagggtggttatgtgccaaaatgatactgctggcattggataaaatcgcagatttgaatacttctcttgggtgaaccagtacactatttaacgttcccatacctactacgttgacattaataacctggttttttgtccgaaggtttaaaatacagaacatttcccggtcacaatcttttaaaaaatcctgaaagagttctgccacatcacagggattttttaattctttactactgtatagaggaggttcttccaccaggcgtatacttaccacatctattttatgtgtcttctccatgttcttcctttccaaaacaaatctccagcataattccctccggcagattttttaaaagtctttccaactgttctaaattcatttctatttgatatgtttcagccattctgccacctttcccatgatatacaaaaagagtgcctgataaaagaactgcactctttttgtcctatcctttttctactttaccgacttataatttttgctgttgcctaattttttctcgtctgtcataccttttcctttacagataaaagaaaaagttcctttcagattacattactcctgctttgtctgcaacgccttttcgtgaaggttggtattgaaaagcgcatacagcggattggcttctttttccatacggttatcaaatggaatacaggtatttccatacttaatgatccccgtaccggaaggagaattatctacatattttaattgtgcttctggaattcctgctgcagtggataattcctgactgtctacattggactgctttaacagggcaataaactcactgttccccagcatggtcatggctgtatagttctgcagcatatcaaccaaattttgggtgattcctgtgcatagtcccccttgcttcctcacttttttccagaggctgaacaaaaatttcgcactatactcccggtcaagaaccgtatggaactcatctatataaagccaggttgcccttcctttctttgcgttttctgcaatcctggcactgatattttccagcatgaccagagtggaaatggctcccagctctttccccaggtccctggtaccatagacaatgaaccttgcctgtacattcacattggtatggttattgaaaatatttaaagagccatttacaaacagctccaacgataaagcaatgtcctttgcctcttcttctggctgctccaacaataactcataaaattctgacatggtagggatatgcttttcccttgcctttgcaatgtcgatatacagctttcgtacacaacggtctataatggatttatggcggctgtttagattatccccgtaacattgttcacacagccccagcataaattctcctttatctcggatatatccctgggaatcgtttaaatccagcgcccagacatccatctccaaaggattgatgtaattctttgtataggtagacaggttaatgattgccgcctggtttcccagggcttctgcaatatcaaaatattccagtgtcggatcgatacagataatatcatcatctgttcctaagaacacctgcagcatttccgacttactgaaataggattttccggagccggggacaccgaataccattccatttccatttgccagttttttccggtttccaatgcaaaggttatgagaaacctggttaatgccatagcagacgccggacttttcgtttaattcctgtacattaaagggaagaagggctgcaatatcccttgtgagcatggtccgcattgtgctgatctgccggtttcccactggaagtatggtattcatagcttccctctgctgataatagtgggtttcaatctggcacatgcgtccattgccgatatttttaatggtttcggttacactgtctagctccttcttgtcctctgccatgatcaggaaattaacccctgtataaaacaggttctggtcattttcccgcacgtcgtccataagatttacaatcttctccttctggactttcttgatatgagaaatgtcactggaaaagtcgttatttttattacggactctctgctgctttaaaatatcattttcaatgcccagatatttcttctgaagaaccttatttgccagttcttttggtactggtacaatgcagattgtagtgatgctatgaaccggaagactggtaatctcatttaaaaaggtatccgataaagaagacggatattttttaatgaataatgccctgcattttttccgttccgtttcaaaataacctgggtaaaactgcatataccctggtgaaatatcatttttaggatcaccgcccttttttaacgcctgtctgaaatcaaaggagaattgttcttcttcccctatacggtaaaaattgaaaagtacccgcagccgctcttctgcatttaattcttcaatgcaggaaccaagttctccaaagttctgttttaaggtagcttcaaaagtggcaaaaaatgcttttgcctgttcgtaggatttccgttctacacatacagtcagcagtttttcctgctcaatcccctgccttccatctacaatgcgcttttcaataatctggttataacttccacgcagccagttaaaaccatctcctttttcctggaaaagtacatgctcccggaaatcctgcatatttttattccgattaaaaatggtaataagaaaatatacatcaatggcatttaccgtcttacaatactgctttaaaatccgcatctgttcttctgcacctgcggttacatagttaatatccaaaaaacgatatgtcttggaatatatccccttccctacttcaaaaatgccattttctgcaattctcccaatccccatgacttcctgaagatatttcggggattttactgctttatctgctttttttaactggtcaaacttatctgaaaaaattgacaatctctaatttcctcctttcaggcagatgggaccacaaacacagcagcttccatctgccgctacatgtctgtgtatccctctcctgaaatggagagcaggcgctatttcacgccttgattgaatattctggtcaacggtacatcttataccacaccgctgctgccgcaccaagtacaatcatcactaccgttacgattcccatacggattgccttctttttcaccacgttgacatcaccacctttcttctcttttttctgttcctttttcctttgctgtacttcccgttcttcttcctgacgggtttccatataaatctgtttcagttcctgcaccgattccgtagagccatacaccaaagggcggttaaaaaaggaaaaataaatcatcttccctgcaaactgccagaatgtcagcccatgatagttataaaacccagtcagtgccagaggtacaacaaaaggggttgccacataacagctcaaagtaatcccgattttttcatacaaaagcaggacaatcccagttcctacgcccaatgccaatgccgaaaacaaaaactgttttgctgtaagtcctagaaccagggattctttataatgctgtaggtcctcacttaattcaatctccatacataacctcctgtatctgttttttatctgctctgtcttcgctcttcctgcatggttttctgtaatccatgttgattgcaaaaggcggcaaccccagcctggtcaaacttacgcagctcctccagatgaaatttcaccaccgcgtactgccccataccggattgtgccttccagggaagcaaagttcccagtccatgctcctgaataaattggatattttccttactaaaatcaccgctgatacaggcagttccaggttccaggcaatatccgggaaggtttacggtcaaatctgaaaacggttcccacgccccatcttccttactatacagttccacataaaggttctggttcattgcgtaataatctacccgcaatgccagttcttcggttccatacgcccattgaaaatctgctgttttgatttccttttgaaattctggattttttacttctccccgttcctggtatgcctgctcataggctgcatatccctccgggtccaatttctttaaagtttcttcctgaaattcaaacagtggatattccatacaaccagaacagcaaatttcttcttttaactgtccaagcccgttttttttgacaaattctacgatctgctccagatcatagcctgggagcaaaaaggtctggttcttttccagcggaattcccatatctgtggtcaattcaaaaagtttccatatctcttcctctttttccgtaaacacacaaactttgatgtttttatcagccggataagttgcaacttccagccagacctcatagatctccccattgccaaaatccaggctgagtttttcttcctgttccatttacatatcctcccttcttaccggctcctgctctttgcagacagaagcctttcttttcccttttcaaaatattcttcattaatttcaatgcagattgcattccgttcatttaaaagtgctgcttcccccagggaaaacgaacctgcaaactgatccagtacccactccttttcttctgttacaaatccaaggatctgctgcaaaagttgcactggtttttctgcctgatgaatacgggagtttttccctggcggttcaatgtcaaagaccgttggaagcattcccctggcgcctgacatatagtgggatattcctggctccgccttatcctttttcgcatctgggcgtaaattcctggcttttcctttcgtaaaaaatgcaatctcttccgtatttttagattttcttcccgtattggcaacgaaatttccttttttccaggcgacttttgcataatattcaagtcctgcttctttcgccatttttttcatctgatagaggtgttcataattttccccattttcttccggcatgaactctaccagaaaacacccttttttcaacacccggtatttttcatcaaagtcttcctgcgtatattgaaaacattcataggcggcaaaatcccggtttccccctttcaggctttttttcaggtcataagcatggtctgtaataatggcatctatactgttatcttttaaaaagctcaaatcccttccatttccctgaaccagcatacaagttacctcttctccgtcctgttctttggtaaccgtatagactcctttggctatcctggaaaaaagccccttttctattccctcataaattcttgcccggatactgggttcttttacctcttttacctgttctacacaagccactgcttctttaaggctgaagcattctgcgtcctgaaaatattcaaatagtgtcatctgtatccctttttcctgcacaatcctttcctcctacaatcccagtgccctggaagtcaggttctgcgctccttttacagtgcctaccgtcagcgcaaccgtaaaggtcatttcccccaaataaatcagggttttggcccagtcctcataatctccggtaaaggtcggaagtccggaggaaataaactggttacacaaaaggattgccagcgccattgtgactgcctcaaaaacgacactgataaaatatttcatataggctacaaaggtattgctaagcccccggtttccagccagggtactgctggcaatcgccccaaaaggtacaattaccataattttcaaaaagcggaaataaacattgtacagcaggaagaaaccacagataataacgattaaagacaggaaaacagcaagtatcaggaacacgatactggttccaaatcccaaatctttgatcacttctgcctgcgccgggtcaatggataactccacactctggttttgccccaaatgccccaccaggtttccacaggaagtaaacagggctttcataatggtaatgttataagataccagccactgtgcaatggcaacccggataaacatacggaggattgcttcaaaccgaatttcttcccggatatctaccgactctgcacaaaacccaatgacgaaaaaaaggactaccagggcagagcctatcccaacaaaaaggggttcaatcccttcaatgatcccccagggcccgcctcctttgaacccggtaggggactgtcctaaaagttcaaatacgaggctgacctggttattccaaaatccaaacacgatttccaaaagtgcaaggatcgcctctcctaaattaaacatcacttcacctctcttcttatctgcttatctcaaaaagaagaatggttttagctaattcccaggaaagtaagaacggaggaaatggctgccataataagccctgcaacaattcctttaatggcactgttcatagaagaactgtcctgctgttggtaagcctgtgcaaattccatcacgttttttgccaggataatcacacccaccgcaccgataatactgatcaccagtgtctttaaattcataagcggctgtgttacgtcacttaccccggaagccatgacagtctgggggaacagggaaacagtggcagcgcttactgccaggactcccagtagagattttttcaagcggttctgtttctttctgataacctctttgatcttcatatctttttactccttttcatgtgattgataccgcattacgcaaaaagacagatttttgaaaacctgccctgcgtaatgcaaaaactacaggtttccaaaaatctgccttctttaatccgaggctgtttcttttgtaaattttttacggatttccttcatcttttcagcactgttttttgtatctgccatttgaaggattttatcatacgaaattccagcaccaatggcaagcatgatttctcccaactgttcctcattataaacatggctttctaataattcagaaagtttttcttcctctgtctgtaccggtttttccgttttcttcggcggcctcacctcctctaccgttctcttcttctggttctctttcagctcttcctccgaaaaaatcttcttaggaataggctcataagaaaaaatttcatcaaaagacagttccacaatctgaacatcttctccctgttcctttttcttcttataataatccagggattcttcacttaaaatctgtaccgcctgtttttgggcagccattctgtcatggatataaggcgcagccccgccatcttctgtttccgaaaatctggagtgtgcaaaagtattgtatttcttatcaataataggatcacaacccctgattaacaaaatacactctgagttatccagctttcgggtttcgtccggtgtcaaaagctcacgccccagcacatcataattccgggaactgctcccttgccggcctttggtttccccactgctttttttatcaatggttccttttcccagggactcactgatatacttatgcgtggactgttcattcccaccaagatataccagagaatcacaattacccggtatggtttcccaggttttctcaaacaaagccttgatctgggcaaggttttggataaaaatggtacatgaaatattcctggaacgcatggtactaaggaggctgcagtagtcatctggcaatggcacgttggcaaattcgtccagcatgaaattcacgttaatgggaagttttccattataatggaagtctgcctggtaatacaattcctggaaaatctgggaataaagcataccaattaaaaaggcataactcttatccgaatccggcgttacacaaaaaagtgcagtcttccggtttctgtccccgtcaacaccaatcccaatctcctcaatctccatttcatcatgatccagaatccgcaaaatttgtgggttctgtaacaatcccagccttgcatttgcggaaatgatgatactccttaccgtatctccggcaccccgtaccactttattatactggattaaagcagggtggttgcttcccttttttctctccagtctgcggaaacgccggtctaaatcagaaggggaaccgtctgcatggacttctgcctcattcaagagctgcaaaaccatacggaaattccttttctccatttcacactcctgccacacataaagaaaaatggcctgcaagtacaaagactcggctttctcccagaatggatcactgggctgtgcgtttttcggagtggtattattgatcaggttagtaaccagttttacaatatctgtttcagagcggatatagcggaatgggttatatccgttagactgctccatttccaccaggttcagcacccgtatccggtatccatgcgctttcagcatacctccgcagcatcttaaaatctcccctttgggatctgtaatgatctgggaagccctgcttaactgaaggagattgggtttcaccatgaacaaggtttttccagcgccgcttcctccgattaccaggacatttaggtttctcctggtctttctggtattcatggacagcctgacattctgggataagatcagattattgtgttcatctttatccgcaaactgctttgccacctttttcggatctgcaaaaacagcggtaccaaattcctgtcccggcatatagtttttccggctggttacatacatgaccataccgatcacatatacaaaaatccccagaatgattgcttttaaggaagtttcgttccaataattggcaaacggggctgccatcacctgatccagacggtttaaaaaataattgatatcctttccgggctgataacacacgttcaagagataacctccatagccggaagctatgccaccaataagatacatgccccaggactgtttcttctttttctgaattgctccggttctctacctcctttgcccctgtatggttcttctccctgcttccaggttctgttgtgccttcctgtaattctgctcccttcttctgcgtatcttttcctgctcctgtctggcacgttccctgtgtaccgggtcatagctttccctatataaatcttcccccgaagtttttctaagaaaacggtcctccaggtctaaaattgcatactccttcttcttttccaatcctgcaaaaatcgtcttatggtcattaatccagctaatttccgatttatccagccagataaattcattcttacggtacggaatcctggttttgatatgatgctctgtttcttcatataccagcttctggtctatggtaatggcattcacacctggattgttccgtttctccttttggatacgccgaatgacctgcatcttttcttctgtttcctggctgcttccagtgctgcgtcttttggcttcctcttccccaaacaactgtttccactgctgggaatctaccaattcttcaacctgttccggtgtcctggtcagtgtcaccgtaccttccttccctttttccaaaatcccctgttcttccatgtagcagataatcggccagatctgaagccaggtcatattcagacgggaacggacattactgatcttctccacctggtttttcgccagctcccgcgcaaccagttcacactccttcggctccggcagggcaggcttttttacttcttctactataaatgctaatataagaatgtacagaaatgatcatttaaaaatgtacaaaatcacattataataaattctctacggaggaatttattatgatatatacaccaaagattactagtgacattcagatcaattctttaagggatctggtaaaactaaccccttttttggaggacagtacattgaaaattaataaaagtcagattgccagagagctgggaaaagatcgacggacggttgataaatatctaaaaggatatgaaaaaccaacagcccgcaggcgttcatcttgcattgatgattattatgatatcatcaaagatcttctttccgatgaaaaccagcagattttctattataaacgtgttttatggcaattcttaaaagataatcatgggctttcctgtgcccagtcaagtttccgcagatacatcagccagcattcggaattccagtcttattttgaacgaaggcagaaacgacatatcaaaaagaaatctcatctgcgttttgaaactcctcttgggaaacaggcacagctggactggaaagaatccataaagtttctgttaaaatccggtgaatggatcgatatcaacatctttgtattgctgctgtcatcatctcggtttcgtgtttacagattatcattatcgaaaacacaggatatcttatgttcctttatcgatgatgcctttgaaacattcggtggagttcctgaagaacttctgacagataacatgaagacggtcatggatcagccacggactgcttacagtaaaggaaaagtgaatccacgctttgcccagtttgcttcagattatggatttaaggtacgaccctgtattgctgcacggcctcagacaaaagcaaaagtagaagctccgatgaaactgctcgatgaaatctatgcttataacggacttctcgattatcatgagctcaatcaactggtccataaactgaatgaacggatcaatcatgcggtgcacccaggaaccggaaggatccctgtgatgtatcttcaaaaagaaaaggctcacttatcaccacttccacgcaatgtgataagaaagccttatcagatgacccatacaactgtaaaagtgaattcatcctgtatgatcacttatcgttccaatcaatattccgtaccaccaaaatatcttggaaaacgtctggtattacaggtatatgataattatctgtatgtgtattataacacagaactgatcgtgatacatccgatcagtgcaaaaaaacttaattatacacacgatcattatgttgctatcagtaaacagacattcaaagagcagacaatggatattgaaaagatcgcaaaagaaaacctgacacagataggagcaatgtttaaaaatgaatagcacatatgtacaattaaagaaaaaccttgagtatctgaaattgaatcagatggatcttcatcttgatgaagtgattgatctgatcacttcgtcaccattatcatttacggaaggactctgtaaactaacgaattatgagattgattttaaagaagcaaacatgatccgttccatggtaaaagtcggagctttccctcatcaaaaaggaatcagtgactttgattttgaatttcagccatccgtcaatccggaagagatcaaggattttgcaactttaagatttctggaaaatgctgaaaacatcgtgtttttaggtccgagcggagtaggtaagacacatcttgccactgcgattggagtaactgcagcaaaaaaacgttacagtacatattttatcaaatgccatgatctgatcatgcagctaaaaaaagcaaaactggagaatcgtctagaagcaagattaaaacactttttcaaatataagctgctgatcattgatgagcttggttatcttccgattaaaaaagatgatgcaaagctgtttttccaactgattgacaagcgatatgaaaaaagaagtacgatcattaccacaaatatcaactttaattcatgggatgatgtattttttgatccagtgatcgcaaatgcgattcttgaccgagtgttacatcatgcacatgtggtaaatatcacaggaaaatcttatcgcttaaaaaaatataccgatcaagaggaagaatagcaaaaatgtacattcttaaatgatcaaaaatgtacattttaatgttgacatttatattctaccaactgctctaccttatccggctctgcattttcatagtattcatctaacgtcccaatattggaatgttcaatttttgccatcatggactgaatacggggcgctgcctgggaatggaacaaaatttcactcataccgtccttctcatttaaatccggcaaatg
